(12) United States Patent
Champion et al.

(10) Patent No.: US 12,049,513 B2
(45) Date of Patent: Jul. 30, 2024

(54) ONCOLYTIC GROUP B ADENOVIRUS EXPRESSING A STROMA-TARGETED BISPECIFIC T-CELL ENGAGER

(71) Applicant: AKAMIS BIO LIMITED, Abingdon (GB)

(72) Inventors: Brian Robert Champion, Abingdon (GB); Alice Claire Noel Bromley, Abingdon (GB); Joshua David Freedman, Chigwell (GB); Kerry David Fisher, Witney (GB); Leonard William Seymour, Wootton by Woodstock (GB)

(73) Assignee: AKAMIS BIO LIMITED, Oxfordshire (GB)

( * ) Notice: Subject to any disclaimer, the term of this patent is extended or adjusted under 35 U.S.C. 154(b) by 1046 days.

(21) Appl. No.: 16/329,098

(22) PCT Filed: Aug. 29, 2017

(86) PCT No.: PCT/EP2017/071674
§ 371 (c)(1),
(2) Date: Feb. 27, 2019

(87) PCT Pub. No.: WO2018/041838
PCT Pub. Date: Mar. 8, 2018

(65) Prior Publication Data
US 2019/0194690 A1 Jun. 27, 2019

(30) Foreign Application Priority Data

Aug. 29, 2016 (GB) .................................. 1614607
Jan. 13, 2017 (GB) .................................. 1700663
Apr. 19, 2017 (GB) .................................. 1706219
Aug. 28, 2017 (GB) .................................. 1713765

(51) Int. Cl.
| | |
|---|---|
| *C07K 16/30* | (2006.01) |
| *A61K 35/761* | (2015.01) |
| *A61K 39/395* | (2006.01) |
| *A61P 35/00* | (2006.01) |
| *C07K 14/52* | (2006.01) |
| *C07K 16/28* | (2006.01) |
| *C07K 16/40* | (2006.01) |
| *C12N 15/86* | (2006.01) |
| *C12N 15/861* | (2006.01) |
| *A61K 35/768* | (2015.01) |
| *A61K 38/00* | (2006.01) |
| *A61K 39/00* | (2006.01) |

(52) U.S. Cl.
CPC ............ *C07K 16/30* (2013.01); *A61K 35/761* (2013.01); *A61K 39/39558* (2013.01); *A61P 35/00* (2018.01); *C07K 14/521* (2013.01); *C07K 16/2809* (2013.01); *C07K 16/40* (2013.01); *C12N 15/86* (2013.01); *C12N 15/861* (2013.01); *A61K 35/768* (2013.01); *A61K 38/00* (2013.01); *A61K 2039/505* (2013.01); *A61K 2039/5256* (2013.01); *A61K 2039/585* (2013.01); *A61K 2300/00* (2013.01); *C07K 2317/31* (2013.01); *C07K 2317/56* (2013.01); *C07K 2317/622* (2013.01); *C07K 2317/73* (2013.01); *C07K 2317/75* (2013.01); *C07K 2319/92* (2013.01); *C12N 2710/10332* (2013.01); *C12N 2710/10343* (2013.01); *C12N 2830/60* (2013.01); *C12N 2840/44* (2013.01)

(58) Field of Classification Search
CPC ... C07K 16/30; C07K 16/2809; A61K 35/761
See application file for complete search history.

(56) References Cited

U.S. PATENT DOCUMENTS

| | | | |
|---|---|---|---|
| 5,358,866 | A | 10/1994 | Mullen et al. |
| 5,595,756 | A | 1/1997 | Bally et al. |
| 5,631,236 | A | 5/1997 | Woo et al. |
| 5,648,478 | A | 7/1997 | Henderson |
| 5,677,178 | A | 10/1997 | McCormick |
| 5,843,772 | A | 12/1998 | Devine et al. |
| 5,972,706 | A | 10/1999 | McCormick |
| 6,291,214 | B1 | 9/2001 | Richards et al. |
| 6,294,377 | B1 | 9/2001 | Haddada et al. |

(Continued)

FOREIGN PATENT DOCUMENTS

| | | |
|---|---|---|
| AU | 2010244348 A1 | 11/2010 |
| CA | 2244213 A1 | 8/1997 |

(Continued)

OTHER PUBLICATIONS

Fajardo, C. A., et al., 2015, Bi-specific T-cell engager-armed oncolytic adenoviruses as a strategy to improve antitumor efficacy, Human Gene Therapy 26(9):A13-A14.*
Champion, B. R., et al., 2014, "Arming" the chimeric oncolytic adenovirus enadenotucirev to deliver checkpoint inhibitors and other therapeutics directly to tumours, J. Immunother. Cancer 2(S3):P46.*
Ahmed et al, Intratumoral expression of a fusogenic membrane glycoprotein enhances the efficacy of replicating adenovirus therapy, Gene Therapy (2003) vol. 10, pp. 1663-1671.
Dias, J. D, et al., Targeted cancer immunotherapy with oncolytic adenovirus coding for a fully human monoclonal antibody specific for CTLA-4, Gene Ther. Oct. 2012; 19(10):988-98.

(Continued)

*Primary Examiner* — Jeffrey S Parkin
(74) *Attorney, Agent, or Firm* — Dechert LLP; Andrew T. Wilkins; David M. Lee

(57) ABSTRACT

A modified adenovirus, in particular Enadenotucirev (EnAd), armed with a bispecific T cell activator comprising at least two binding domains, wherein at least one of the domains is specific for a surface antigen on a T-cell of interest. Also provided are a composition, such as a pharmaceutical formulation comprising the virus, use of the virus and virus formulations for treatment, such as in the treatment of cancer. The disclosure also extends to processes for preparing the virus.

26 Claims, 138 Drawing Sheets

Specification includes a Sequence Listing.

(56) References Cited

U.S. PATENT DOCUMENTS

| | | |
|---|---|---|
| 6,420,524 B1 | 7/2002 | Craig |
| 7,264,958 B1 | 9/2007 | Transgene |
| 7,288,251 B2 | 10/2007 | Bedian et al. |
| 7,459,153 B2 | 12/2008 | Wadell et al. |
| 7,550,296 B2 | 6/2009 | Hermiston |
| 7,858,367 B2 | 12/2010 | Amalfitano et al. |
| 8,052,965 B2 | 8/2011 | Van Beusechem et al. |
| 8,216,819 B2 | 7/2012 | Hermiston |
| 2002/0019051 A1 | 2/2002 | Lusky |
| 2002/0061592 A1 | 5/2002 | Blanche et al. |
| 2003/0017138 A1 | 1/2003 | Havenga et al. |
| 2003/0044384 A1 | 3/2003 | Roberts |
| 2003/0096787 A1 | 5/2003 | Perricaudet et al. |
| 2004/0136958 A1 | 7/2004 | Wadell et al. |
| 2004/0151696 A1 | 8/2004 | Johnson et al. |
| 2004/0213764 A1 | 10/2004 | Wold et al. |
| 2005/0175589 A1 | 8/2005 | Iggo et al. |
| 2005/0186225 A1 | 8/2005 | Evans et al. |
| 2006/0140909 A1 | 6/2006 | Wickham et al. |
| 2006/0292682 A1 | 12/2006 | Hawkins et al. |
| 2008/0069836 A1 | 3/2008 | Nabel et al. |
| 2008/0292592 A1 | 11/2008 | Chuda et al. |
| 2009/0022738 A1 | 1/2009 | Hofmeister et al. |
| 2009/0311219 A1 | 12/2009 | Bonastre et al. |
| 2010/0047208 A1 | 2/2010 | Ke |
| 2010/0297072 A1 | 11/2010 | Depinho |
| 2011/0034560 A1 | 2/2011 | Jacobson et al. |
| 2012/0034228 A1 | 2/2012 | Kufer et al. |
| 2017/0266243 A1 | 9/2017 | Champion et al. |
| 2018/0140649 A1 | 5/2018 | Champion et al. |
| 2018/0311291 A1 | 11/2018 | Champion et al. |
| 2019/0076493 A1 | 3/2019 | Champion et al. |
| 2019/0194690 A1 | 6/2019 | Champion et al. |
| 2019/0233536 A1 | 8/2019 | Champion et al. |

FOREIGN PATENT DOCUMENTS

| | | |
|---|---|---|
| CN | 1241632 A | 1/2000 |
| CN | 1242051 A | 1/2000 |
| CN | 101381742 A | 3/2009 |
| CN | 1961961 A | 5/2010 |
| CN | 102586327 A | 7/2012 |
| DE | 102005055128 A1 | 5/2007 |
| EP | 1054064 A1 | 11/2000 |
| EP | 170269 A1 | 5/2007 |
| JP | 2000504334 A | 4/2000 |
| JP | 2002531133 | 9/2002 |
| JP | 2002541792 A | 12/2002 |
| JP | 2008531700 A | 8/2008 |
| JP | 2015526450 A | 8/2015 |
| SE | 0100035-5 | 1/2001 |
| WO | 1998/022609 A1 | 5/1998 |
| WO | 1999/018799 A1 | 4/1999 |
| WO | 2000/15823 A1 | 3/2000 |
| WO | 00/32754 A1 | 6/2000 |
| WO | 00/34494 | 6/2000 |
| WO | 2000061726 A1 | 10/2000 |
| WO | 00/73478 A3 | 12/2000 |
| WO | 01/11034 A2 | 2/2001 |
| WO | 2001/53506 A2 | 7/2001 |
| WO | 2001/092549 A2 | 12/2001 |
| WO | 2001/094413 A2 | 12/2001 |
| WO | 2002/099119 A2 | 12/2002 |
| WO | 2003/040170 A2 | 5/2003 |
| WO | 2003/064666 A1 | 8/2003 |
| WO | 2005/010149 A1 | 6/2004 |
| WO | 2004/108893 A2 | 12/2004 |
| WO | 2005/086922 A2 | 9/2005 |
| WO | 2005/107474 A2 | 11/2005 |
| WO | 2005/118825 A2 | 12/2005 |
| WO | 2006/060314 A2 | 6/2006 |
| WO | 2007/027860 A2 | 3/2007 |
| WO | 2008/080003 | 7/2008 |
| WO | 2006093924 A1 | 9/2008 |
| WO | 2009/143610 A1 | 12/2009 |
| WO | 2010/037835 A2 | 4/2010 |
| WO | 2012/024351 A1 | 2/2012 |
| WO | 2013/026833 A1 | 2/2013 |
| WO | 2013/074507 A1 | 5/2013 |
| WO | 2013164754 A2 | 11/2013 |
| WO | 2014029702 A1 | 2/2014 |
| WO | 2014138314 A1 | 9/2014 |
| WO | 2015/059303 A1 | 4/2015 |
| WO | 2015/059465 A1 | 4/2015 |
| WO | 2015059303 A1 | 4/2015 |
| WO | 2015/077624 A1 | 5/2015 |
| WO | 2015/097220 A1 | 7/2015 |
| WO | 2015153912 A1 | 10/2015 |
| WO | 2015155370 A1 | 10/2015 |
| WO | 2016030489 A1 | 3/2016 |
| WO | 2016/139463 A1 | 9/2016 |
| WO | 2016/146894 A1 | 9/2016 |
| WO | 2016146894 A1 | 9/2016 |
| WO | 2016/174200 A1 | 11/2016 |
| WO | 2017/103290 A1 | 6/2017 |
| WO | 2017/103291 A1 | 6/2017 |
| WO | 2017/161360 A2 | 9/2017 |
| WO | 2018/041827 A1 | 3/2018 |
| WO | 2018/041838 | 3/2018 |
| WO | 2018/075978 A1 | 4/2018 |
| WO | 2018/083257 A1 | 5/2018 |
| WO | 2018/083258 A1 | 5/2018 |
| WO | 2018/083259 A1 | 5/2018 |
| WO | 2019/043020 A1 | 3/2019 |

OTHER PUBLICATIONS

Alisky et al, Gene transfer to brain and spinal cord using recombinant adenoviral vectors, Methods in Mol Biol, vol. 246, 91-120, 2004.

Arafat et al, Effective single chain antibody (scFv) concentrations in vivo via adenoviral vector mediated expression of secretory scFv, Gene therapy, vol. 9, 256-262 (2002).

Biery et al, A simple in vitro Tn7-based transposition system with low target site selectivity for genome and gene analysis, Nucleic acids res, 28: 1067-1077 (2000).

Cascone et al, Upregulated stromal EGFR and vascular remodelling in mouse xenograft models of angiogenesis Inhibitor-resistant human lung adenocarcinoma, J. clinical invest, vol. 121, No. 4, Apr. 1, 2011, 131-1328.

Casimiro et al, Comparative immunogenicity in rhesus monkeys of DNA plasmid, recombinant vaccinia virus and replication-defective adenovirus vectors, J. Virol 77, 6305-13 (2003).

Database WPI, Week 20267 (See also CN102586327).

Mizuguchi et al, Approaches for generating recombinant adenovirus vectors, Advanced Drug Delivery Reviews, 2001, vol. 52, pp. 165-176.

Champion et al, Jul. 2016, Developing tumor-localized, combination immunotherapies, http://psioxus.com/wp-content/uploads/2016/12/AACR-Poster-Apr. 2016.pdf.

Dyer et al, Oncolytic Group B adenovirus Enadenotucirev mediates non-apoptotic cell death with membrane disruption and release of inflammatory mediators, Molecular therapy Oncolytics, vol. 4, Mar. 2017, 18-30.

Dyer A. et al, Antagonism of Glycolysis and Reductive Carboxylation of Glutamine Potentiates Activity of Oncolytic Adenoviruses in Cancer Cells, Cancer Res. 79:331 , 2019.

Hoffman, D., et al., Efficient generation of double heterologous promoter controlled oncolytic adenovirus vectors by a single homologous recombination step in *Escherichia coli*, BMC Biotechnology 2006, 6:36.

Kuhn, I, et al., Human adenovirus B strain ColoAd1, complete genome, GenBank: EF011630.1.

Kuhn, I., et al., Directed evolution generates a novel oncolytic virus for the treatment of colon cancer, PLoS One. Jun. 18, 2008;3(6):e2409.

Mei et al., Comparative analysis of the genome organization of human adenovirus 11, a member of the human adenovirus species B, and the commonly used human adenovirus 5 vector, a member of species C, J Gen Virol. vol. 84, No. part 8, Aug. 2003, 2061-2071.

(56) References Cited

OTHER PUBLICATIONS

Janssen, J. M., et al, Development of an AdEasy-based system to produce first- and second-generation adenoviral vectors with tropism for CAR- or CD46-Positive cells, J Gene Med 2013; 15: 1-11.
Freedman J.D. et al, An Oncolytic Virus Expressing a T-cell Engager Simultaneously Targets Cancer and Immunosuppressive Stromal Cells, Cancer Res Nov. 18: 1-14, 2018.
Frentzen et al, Anti-VEGF single=chain antibody GLAF-1 encoded by oncolytic vaccinia virus significantly enhances anti-tumor therapy, Proceedings Nat Aca Sci, vol. 106, No. 31, (Aug. 4, 2009), 12915-12920.
Forrester et al, Serotype-specific inactivation of the cellular DNA damage response during adenovirus infection, J. Vir 85(5), 2011, 2201-2211.
Fountzilas et al, Review: Oncolytic virotherapy, updates and future directions, Oncotarget, vol. 8, No. 60, May 31, 2017.
Fu et al, Expression of a Fusogenic Membrane Glycoprotein by an Oncolytic Herpes Simplex Virus Potentiates the Viral Antitumor Effect, Molecular Therapy, Jun. 2003, vol. 7, No. 6, pp. 748-754.
Galanis et al, Use of Viral Fusogenic Membrane Glycoproteins as Novel Therapeutic Transgenes in Gliomas, Human Gene Therapy, 2001, vol. 12, No. 7, pp. 811-821, Abstract.
Li, X., et al., A one-step ligation system for rapid generation of armed, conditionally-replicating adenoviruses, Biotechnol Lett (2013) 35:1215-1221.
Grill et al, Mol. The organotypic multicellular spheroid is a relevant three-dimensional model to study adenovirus replication and penetration in human tumors in vitro, Therapy, vol. 6, No. 5, 609-614 (2002).
Heise et al, Onyx-015, an E1B gene-attenuated adenovirus, causes tumor-specific cytolysis and antitumoral efficacy that can be augmented by standard chemotherapeutic agents, Nat Met, vol. 3, No. 6, 639-645, 1997.
Champion et al, NG-348: a novel oncolytic virus designed to mediate anti-tumour activity via the potent and selective polyclonal activation of tumor-infiltrating T-cells, Cancer research, vol. 77, No. 13, Jul. 2017.
Hermiston, A demand for next-generation oncolytic adenoviruses, Curr. Op. Mol. Therapeutics 8, 322-30, Aug. 2006.
Machiels J-P. et al., A Phase 1 Dose Escalation Study of the Oncolytic Adenovirus Enadenotucirev, Administered Intravenously to Patients with Epithelial Solid Tumors, (EVOLVE) Journal for Immuno Therapy of Cancer 7:20, 2019.
Hermiston T., Gene delivery from replication-selective viruses: arming guided missiles in the war against cancer, J Clinical invest, vol. 105, No. 9, (May 1, 2000), 1169-1172.
Ibrahimi et al., Highly efficient multicistronic lentiviral vectors with peptide 2A sequences, Human gene therapy 20: 845-860.
Ilingworth et al., Preclinical Safety Studies of Enadenotucirev, a Chimeric Group B Human-Specific Oncolytic Adenovirus, Mol Ther Oncolytics. 5:62, 2017.
Hermiston T. et al., The Discovery and Development of Selectively Replicating Adenoviruses-Anticancer Agents, J Tumor targeting 2000, vol. 4 No. 4, 218-224.
Jolly D et al., Viral vector systems for gene therapy, Cancer gene therapy, vol. 1, No. 1, (1994) 51-64.
Kanerva et al., Gene transfer to ovarian cancer vs normal tisuses with fiber-modified adenoviruses, Molecular Therapy, vol. 5 (6), 2002, 695-704.
Kleinman & Martin, Matrigel: Basement membrane matrix with biological activity, Seminars in cancer biology 15, 378-86, Oct. 1, 2005.
Lai et al, Adenovirus and adeno-associated virus vectors, DNA Cell Bio, vol. 21, No. 12, 895-913 (2002).
Kuhn et al, 319. ColoAd1, a chimeric Ad11p/Ad3 Oncolytic virus for the treatment of colon cancer, Molecular Therapy, vol. 11, Aug. 15, 2005, p. 124.
Lee et al, Replicating adenoviral vector-mediated transfer of a heat-inducible double suicide gene for gene therapy, Cancer gene therapy, vol. 8, No. 6, 397-404 (2001).

Liao et al, Stable expression of chimeric anti-CD3 receptors on mammalian cells for stimulation of anti-tumor immunity, Cancer gene therapy 10, 2003, 779-790.
Kangasniemi, Improving oncolytic adenoviral therapies for gastrointestinal cancers and tumor initiating cells, Cancer Gene Therapy Group, Jan. 1, 2010, 1-70.
Luckow et al, Efficient generation of infectious recombinant baculoviruses by site-specific transposon-mediated insertion of foreign genes into a baculovirus genome propagated in *esherichia coli*, J. Vorl. 67: 4566-4579 (1993).
Marino et al, Development of a versatile oncolytic virus platform for local intra-tumoral expression of therapeutic transgenes, pLOS One, May 18, 2017, 1-23.
McConnell & Imperiale, Biology of adenovirus and its use as a vector for gene therapy, Human Gene therapy 1022-1033, Nov. 11, 2014.
McVey et al., Rapid construction of adenoviral vectors by lambda phage genetics, J. Virol, vol. 76, No. 8, 3670-3677 (Apr. 2002).
Meinschad & Winnacker, Recombination in adenovirus. I. Analysis of recombinant viruses under non-selective conditions, J of Gen. Virol. 1980, vol. 48, 219-224.
Francini, N. et al., Polyvalent Diazonium Polymers Provide Efficient Protection of Oncolytic Adenovirus Enadenotucirev from Neutralizing Antibodies while Maintaining Biological Activity In Vitro and In Vivo, Bioconjug Chem. 30:1244, 2019.
Nemunatitis, J., et al., Intravenous infusion of a replication-selective adenovirus (ONYX-015) in cancer patients: safety, feasibility and biological activity, Gene Therapy (2001) 8, 746-759.
Yu, F., et al., Cancer Associated Fibroblasts-Targeted Oncolytic Virus Results in Enhanced Antitumor Activity in Mouse Model, Molecular Therapy vol. 23, Supplement 1, May 2015.
Chang, C-M, et al., Treatment of hepatocellular carcinoma with adeno-associated virus encoding interleukin-15 superagonist, Hum Gene Ther. May 2010;21(5):611-21.
Cheng, L., et al., Hyper-IL-15 suppresses metastatic and autochthonous liver cancer by promoting tumour-specific CD8+ T cell responses, J Hepatol. Dec. 2014;61(6): 1297-303.
Guo, Y., et al., Immunobiology of the IL-15/IL-15Rα complex as an antitumor and antiviral agent, Cytokine Growth Factor Rev. Dec. 2017;38:10-21.
Ni, S., et al., Evaluation of biodistribution and safety of adenovirus vectors containing group B fibers after intravenous injection into baboons, Hum Gene Ther. Jun. 2005; 16(6):664-77.
Heppner, G. H., et al., Tumor heterogeneity: biological implications and therapeutic consequences, Cancer Metastasis Rev. 1983;2(1):5-23.
Sporn, M. B., et al., Chemoprevention of cancer, Carcinogenesis. Mar. 2000;21(3):525-30.
Auerbach, R., et al., Angiogenesis assays: problems and pitfalls, Cancer Metastasis Rev. 2000; 19(1-2):167-72.
Gura, T., Systems for identifying new drugs are often faulty, Science. Nov. 7, 1997;278(5340):1041-2.
Jain, R. K., Barriers to drug delivery in solid tumors, Sci Am. Jul. 1994;271(1):58-65.
Hait, W. N., Anticancer drug development: the grand challenges, Nat Rev Drug Discov. Apr. 2010;9(4):253-4.
Gravanis, I., et al., The changing world of cancer drug development: the regulatory bodies' perspective, Chin Clin Oncol. Jun. 2014;3(2):22.
Beans, C., News Feature: Targeting metastasis to halt cancer's spread, Proc Natl Acad Sci U S A. Dec. 11, 2018;115 (50):12539-12543.
Mukherjee et al., Identification of EpCAM as a Molecular target of prostate cancer stroma, American J of pathology, vol. 175, No. 6, Dec. 1, 2009, 2277-2287.
Demers et al, Pharmacologic indicators of antitumor efficacy for oncolytic virotherapy, Cancer research, vol. 63, No. 14 (Jul. 15, 2003), 4003-4008.
Oorschot et al., Apoptin induces apoptosis in human transformed and malignant cells but not in normal cells, PNAS, May 1997, vol. 94, pp. 5843-5847.
Parks et al., Adenoviral vectors: prospects for gene delivery to the central nervous system, Gene Therapy, 1999, vol. 6, 1349-1350.

(56) References Cited

OTHER PUBLICATIONS

Boni et al., A Phase 1 Mechanism of Action Study of Intra-Tumoural (IT) or Intravenous (IV) Administration of Enadenotucirev, an Oncolytic AD11/AD3 Chimeric Group B Adenovirus in Colon Cancer Patients Undergoing Resection of Primary Tumour, Annals of Oncology 25 (supplement 4): iv361-iv372, 2014.

Nettelbeck et al., Cellular genetic tools to control oncolytic adenoviruses for virotherapy of cancer, J Mol Med (2008) 86:363-377.

Di, Y., et al, Activity of a Group B Oncolytic Adenovirus (ColoAd1) in Whole Human Blood, Gene Ther. Apr. 2014;21(4):440-3.

Puthupparampil et al, Tumor growth inhibition from tumor targeted delivery of diphtheria toxin gene, Mol Therapy, 2005, vol. 11, supplement No. 1, A124.

Human Vaccines & Immunotherapeutics 8:11, 1550-1553; Nov. 2012, Unique anti-cancer agent ColoAd1 enters the clinic, www.landesbioscience.com.

Fuerer and Iggo, 5-Fluorocytosine increases the toxicity of Wnt-targeting replicating adenoviruses that express cytosine deaminase as a late gene, Gene Therapy (2004), 11, 142-151.

Rancourt et al, Conditionally replicative adenoviruses for cancer therapy, 6th delivery review 27 (1997): 67-81.

Richards et al, The Amid system: Generation of recombinant adenoviruses by Tn7-mediated transposition in E. coli, Biotechniques vol. 29, No. 1, 146-154 (2000).

Roshon et al, Gene trap mutagenesis of hnRNP A2/B1: a cryptic 3' splice site in the neomycin resistance gene allows continued expression of the disrupted cellular gene, BMC Genomics, vol. 4, No. 2, 1-11 (2003).

Sirena et al, The nucleotide sequence and a first generation gene transfer vector of species B human adenovirus serotype 3, Virol. 343, 283-98 (2005).

Sood et al, Functional role of matrix metalloproteinases in ovarian tumor cell plasticity, Am. J. Obstetrics Gynecol. 196, 899-909 (2004).

Stellwagan et al, Gain of function mutations in TnsC, an ATP-dependent transposition protein that activates the bacterial transposon Tn7, Genetics 145: 573-585 (1997).

Stevenson et al, Selective targeting of human cells by a chimeric adenovirus vector containing a modified fiber protein, J virol. vol. 71, No. 6, 4782-4790, (1997).

Stone, D., et al., Development and Assessment of Human Adenovirus Type 11 as a Gene Transfer Vector, J Virol. Apr. 2005;79(8):5090-104.

Tedcastle A. et al., Actin-resistant DNAse I Expression From Oncolytic Adenovirus Enadenotucirev Enhances Its Intratumoral Spread and Reduces Tumor Growth, Mol Ther. 24:796, 2014.

Thorne et al., Oncolytic virotherapy: Approaches to tumor targeting and enhancing antitumor effects, Sem oncol. 32, 537-48, Dec. 1, 2005.

Tobias et al., Novel primate-crossreactive BiTE antibodies that eliminate cancer cells expressing cMEt, IGFR-1, Fap-alpha, PSCA, Endosialin, CAIX or Her2/neu, Proceedings of annual meeting of American association for cancer res, vol. 51, p. 590.

Tollefson et al., The Adenovirus Death Protein (E3-11.6K) is Required at Very Late Stages of Infection for Efficient Cell Lysis and Release of Adenovirus from Infected Cells, Journal of Virology, Apr. 1996, vol. 70, No. 4, pp. 2296-2306.

Wang et al., High levels of EGFR expression in tumor stroma are associated with aggressive clinical features in epithelial ovarian cancer, Oncotargets and therapy, vol. 9, Jan. 19, 2016, 377-386.

Yan et al., Developing Novel Oncolytic Adenoviruses through bioselection, J Virol. vol. 77, No. 4, Feb. 2003, 2640-2650.

Raki, M., et al., Oncolytic Adenovirus Ad5/3-delta24 and Chemotherapy for Treatment of Orthotopic Ovarian Cancer, Gynecol Oncol. Jan. 2008;108(1):166-72.

Russell, S. J., et al., Oncolytic Virotherapy, Nat Biotechnol. Jul. 10, 2012;30(7):658-70.

Vellinga, J., et al, The Adenovirus Capsid: Major Progress in Minor Proteins, J Gen Virol. Jun. 2005;86(Pt 6): 1581-1588.

Jin, F., et al., Identification of Novel Insertion Sites in the Ad5 Genome That Utilize the Ad Splicing Machinery for Therapeutic Gene Expression, Moleculartherapy vol. 12, No. 6, Dec. 2005.

Hermiston, T.W., et al., Review Armed therapeutic viruses: Strategies and challengesto arming oncolytic viruses with therapeutic genes, Cancer Gene Therapy (2002) 9, 1022-1035.

Funston, G. M., et al., Expression of heterologous genes in oncolytic adenoviruses using picornaviral 2A sequences that trigger ribosome skipping, J Gen Virol . Feb. 2008;89(Pt 2):389-396.

Lee, C. H., et al., Tumor-localized ligation of CD3 and CD28 with systemic regulatory T-cell depletion induces potent innate and adaptive antitumor responses, Clin Cancer Res . Apr. 15, 2009;15(8):2756-66.

Liao, K.W., et al., Activation of lymphocytes by anti-CD3 single-chain antibody dimers expressed on the plasma membrane of tumor cells, Gene Ther. Feb. 2000; 7(4):339-47.

Paul et al, Tumor gene therapy by MVA-mediated expression of T-cell stimulating antibodies, Cancer gene therapy vol. 9, No. 5, 2002, 470-477.

Stone, D., et al., The complete nucleotide sequence, genome organization, and origin of human adenovirus type 11, Virology 309 (2003) 152-165.

Holterman, L., et al., Novel Replication-Incompetent Vector Derived from Adenovirus Type 11 (Ad11) for Vaccination and Gene Therapy: Low Seroprevalence and Non-Cross-Reactivity with Ad5, Journal of Virology, Dec. 2004, p. 13207-13215.

Calvo et al., A First-in-class, a first-in-human phase I study of enadenotucirv an oncolytic Ad11/Ad3 chemeric group B adenovirus, administered intravenously in patients with metastatic epithelial tumors, Journal of Clinical Oncology vol. 32, No. 15 suppl (May 2014), abstract 3103.

Lee, Y-S, et al., Enhanced Antitumor Effect of Oncolytic Adenovirus Expressing Interleukin-12 and B7-1in an Immunocompetent Murine Model, Clin. Cancer Res 2006;12(19) Oct. 1, 2006.

Paul, S., et al., Tumor gene therapy by MVA-mediated expression of T-cell-stimulating antibodies, Cancer Gene Therapy (2002) 9, 470-477.

Diehl, K-H, et al., A good practice guide to the administration of substances and removal of blood, including routes and vols. J. Appl. Toxicol, 21, 15-23 (2001).

Yang, Z-M, et al., Anti-CD3 scFv-B7.1 fusion protein expressed on the surface of Hela cells provokes potent T-lymphocyte activation and cytotoxicity, Biochem Cell Biol. Apr. 2007; 85(2):196-202.

International Search Report and Written Opinion of PCT/EP2020/067668, dated Nov. 5, 2020.

Detergents: Triton X-100, Tween-20, and More, Jun. 10, 2020, Mater Methods 2013;3:163.

Clement, N., et al., Construction and production of oncotropic vectors, derived from MVM(p), that share reduced sequence homology with helper plasmids, Cancer Gene Ther. Sep. 2002;9(9):762-70.

Shashkova, E., et al., Characterization of human adenovirus serotypes 5, 6, 11, and 35 as anticancer agents, Virology Nov. 2, 20095;394(2):311-20.

Ferguson, M., et al., Systemic delivery of oncolytic viruses: hopes and hurdles, Advances in Virology, V 2012, Article ID 805629.

Carlisle, R.C., et al., Human erythrocytes bind and inactivate type 5 adenovirus by presenting Coxsackie virus-adenovirus receptor and complement receptor 1, Blood Feb. 26, 2009;113(9):1909-18.

Chau, L.A, et al., HuM291(Nuvion), a humanized Fc receptor-nonbinding antibody against CD3, anergizes peripheral blood T cells as partial agonist of the T cell receptor, Transplantation Apr. 15, 2001;71(7):941-50.

Fajardo, C. A., et al., Oncolytic Adenoviral Delivery of an EGFR-Targeting T-cell Engager Improves Antitumor Efficacy, Cancer Res. Apr. 15, 2017;77(8):2052-2063.

Hemminki et al., AD3-HTERT-E1A, a Fully Serotype 3 Oncolytic Adenovirus, in Patients With Chemotherapy Refractory Cancer, Molecular Therapy (Aug. 7, 2012), 20(9):1810-1830.

Hotte et al., An Optimized Clinincal Regimen for the Oncolyticvirus PV701, Clinical Cancer Research (Feb. 1, 2007), 13(3):977-985.

(56) References Cited

OTHER PUBLICATIONS

Nemunaitis et al., Intravenous Infusion of a Replication-Selective Adenovirus (ONYX-015) in Cancer Patients: Safety, Feasibility and Biological Activity, Gene Therapy (2001), 8:746-759.

Small et al., A Phase I Trial of Intravenous CG7870, a Replication-Selective, Protate-Specific Antigen-Targeted Oncolytic Adenovirus, for the Treatment of Hormone-Refractory, Metastatic Prostate Cancer, Molecular Therapy (Jul. 2006), 14(1):107-117.

European Patent Office, Opposition Division, Decision Revocation of the European Patent No. EP 3007711, Feb. 21, 2023, Munich, Germany.

European Patent Office, Opposition Division, Consolidated List of Cited Opposition Documents, European Patent No. EP 3007711, Dec. 1, 2022, Munich, Germany.

Riedmann, Human Vaccines: News, Human Vaccines & IMMUNOTHERAPEUTICS (2012), 8(11):1550-1553.

Auerbach et al., Angiogenesis Assays; Problems and Pitfalls, Cancer and Metastasis Reviews (2000), 19:167-172.

Beans, Targeting Metastasis to Halt Cancer's Spread, PNAS (Dec. 11, 2018), 115 (50):12539-12543.

Gravanis et al., TPA as a Therapeutic Target in Stroke, Expert Opin Ther Targets (Feb. 2008), 12(2):1-18.

Gura, Systems for Identifying New Drugs Are Often Faulty, Science (Nov. 7, 1997), 278:1041-1042.

Hait, Anticancer Drug Development: the Grand Challenges, Nature Reviews Drug Discovery (Apr. 2010), 9:253-254.

Jain, Barriers to Drug Delivery in Solid Tumors, Scientific American (Jul. 1994), 58-65.

Sporn et al., Chemoprevention of Cancer, Carcinogenesis (2000), 21(3):525-530.

Murphy et al., Enhancing Recombinant Abtibody Performance by Optimally Engineering its Format, Journal of Immunological Methods (2018), 463:127-133.

Paul, Fundamental Immunology, Third Edition, Laboratory of Immunology, National Institute of Allergy and Infectious Diseases, National Institutes of Health (1993), 292-295.

Rudikoff et al., Single Amino Acid Substitution Altering Antigen-Binding Specificity, Proc. Natl. Acad. Sci. (1982), 79:1979-1983.

Bendig, Humanization of Rodent Monoclonal Antibodies by CDR Grafting, a Companion to Methods in Enzymology (1995), 8:83-93.

Colman, Effects of Amino Acid Sequence Changes on Antibody-Antigen Interactions, Research in Immunology (1994), 145:33-36.

Khantasup et al., Design and Generation of Humanized Single-Chain FV Derived From Mouse Hybridoma for Potential Targeting Application, Monoclonal Antibodies in Immunodiagnosis and Immunotherapy (2015), 34(6):404-417.

Fisicaro et al., Versatile Co-Expression of Graft-Protective Proteins Using 2A-LINKED Cassettes, Xenotransplantation (2011), 18(2):121-130.

Chia S.L. et al, Group B adenovirus enadenotucirev infects polarised colorectal cancer cells efficiently from the basolateral surface expected to be encountered during intravenous delivery to treat disseminated cancer, Virology 505:162, 2017.

Choi, K-J, et al., Concurrent delivery of GM-CSF and B7-1 using an oncolytic adenovirus elicits potent antitumor effect, Gene Ther. Jul. 2006;13(13):1010-20.

Alemany, R., Oncolytic Adenoviruses in Cancer Treatment, Biomedicines 2014, 2, 36-49.

Nemunaitis, J., et al., Intravenous infusion of a replication-selective adenovirus (ONYX-015) in cancer patients: safety, feasibility and biological activity, Gene Therapy (2001) 8, 746-759.

Hemminki, A., Oncolytic Immunotherapy: Where Are We Clinically?, Scientifica, vol. 2014, Article ID 862925, 7 pages.

Hobbs, W. E., et al., Efficient Activation of Viral Genomes by Levels of Herpes Simplex Virus ICPO Insufficient To Affect Cellular Gene Expression or Cell Survival, Journal of Virology, Apr. 2001, p. 3391-3403.

Hu, Z-B, et al., A simplified system for generating oncolytic adenovirus vector carrying one or two transgenes, Cancer Gene Therapy vol. 15, pp. 173-182(2008).

Illingworth et al., ColoAd1 a group B oncolytic adenovirus: preclinical assessment of potency, safety and selectivity, Human gene therapy, vol. 23, No. 10, Oct. 2012, page A19.

Jiang et al., The controlled transgene expression in oncolytic adenoviral vectors with major late promoter for therapy of cancer, Mol. Therapy 13(Supp 1), 2006, S251.

Kwon, O-J, et al., Therapeutic targeting of chitosan-PEG-folate-complexed oncolytic adenovirus for active and systemic cancer gene therapy, J Control Release, Aug. 10, 2013;169(3):257-65.

Lee, Y-S, et al., Enhanced Antitumor Effect of Oncolytic Adenovirus Expressing Interleukin-12 and B7-1 in an Immunocompetent Murine Model, Clin Cancer Res 2006;5859 12(19) Oct. 1, 2006.

Pol, J., et al., Trial Watch Oncolytic viruses for cancer therapy, OncoImmunology 3, e28694; Apr. 2014.

Pützer, B. M., et al., Improved treatment of pancreatic cancer by IL-12 and B7.1 costimulation: antitumor efficacy and Immunoregulation in a nonimmunogenic tumor model, Mol Ther. Apr. 2002;5(4):405-12.

Small, E. J., A Phase I Trial of Intravenous CG7870, a Replication-Selective, Prostate-Specific Antigen-Targeted Oncolytic Adenovirus, for the Treatment of Hormone-Refractory, Metastatic Prostate Cancer, Molecular Therapy vol. 14, No. 1, Jul. 2006.

Nakashima, E., et al., A candidate for cancer gene therapy: MIP-1 alpha gene transfer to an adenocarcinoma cell line reduced tumorigenicity and induced protective immunity in immunocompetent mice, Pharm Res. Dec. 1996;13(12):1896-901.

Kaufman, H. L., et al., Oncolytic viruses: a new class of immunotherapy drugs, Nat Rev Drug Discov. Sep. 2015;14(9):642-62.

Ferrantini, M., et al., Interferon-alpha and cancer: mechanisms of action and new perspectives of clinical use, Biochimie. Jun.-Jul. 2007;89(6-7):884-93.

Plasmids 101: Multicistronic Vectors. Jan. 29, 2015, https://web.archive.org/web/20150129022727/https://blog.addgene.org/plasmids-101-multicistronic-vectors.

Gene Therapy Vaccinia Virus Vectors Explained. Feb. 1, 2015, https://web.archive.org/web/20150201083914/ www.genetherapynet.com/viral-vector/vaccinia-viruses.html.

Ramakrishna, E., et al., Antitumoral immune response by recruitment and expansion of dendritic cells in tumors infected with telomerase-dependent oncolytic viruses, Cancer Res. Feb. 15, 2009;69(4):1448-58.

Liao, K.W., et al., Design of transgenes for efficient expression of active chimeric proteins on mammalian cells, Biotechnol Bioeng. May 20, 2001;73(4):313-23.

Cruise & Lewis, Illustrated Dictionary of Immunology, 2nd Eddition, CRC Press, 1937.

Wüest et al., Construction of a bispecific single chain antibody for recruitment of cytotoxic T cells to the tumor stroma associated antigen fibroblast activation protein, Journal of Biotechnology 92 (2001), 159-168.

Vogels et al, Replication-deficient human adenovirus type 35 vectors for gene transfer and vaccination: efficient human cell infection and bypass of preexisting adenovirus immunity, J of Virology, vol. 77, No. 15, Aug. 2003, 8263-8271.

Reid et al, Intravascular adenoviral agents in cancer patients: lessons from clinical trials, Cancer Gene Therapy (2002), 9, 979-986.

Laurie et al, A phase 1 clinical study of intravenous administration of PV701, an oncolytic virus, using two-step desensitization, Clin Cancer Res 2006; 12(8), Apr. 15, 2006.

Hotte et al., An optimized clinical regimen for the oncolytic virus PV701, Clin Cancer Res, 2007; 13(3), Feb. 1, 2007.

Hemminki et al., Ad3-hTERT-E1A, a fully serotype 3 oncolytic adenovirus, in patients with chemotherapy refractory cancer, Molecular Therapy, vol. 20, No. 9, 1821-1830, Sep. 2012.

Garcia-carbonero et al., ASCO Meeting library Jun. 3, 2014, A phase 1 mechanism of action study of intratumoral or Intravenous administration of enadenotucirev, an oncolytic Ad11/AD3 chimeric group B adenovirus in colon cancer patients undergoing resection of primary tumor.

PsiOxus Therapeutics, Ltd, Press Release, PsiOxus Therapeutics to Release Study Results of Oncolytic Vaccine Enadenotucirev In Cancer Patients, Oxford, UK, Apr. 13, 2014.

(56) References Cited

OTHER PUBLICATIONS

Carlos, A. F., et al., Bi-specific T-Cell engager-armed oncolytic adenoviruses as a strategy to improve antitumor efficacy, Human Gene, vol. 26, No. 9, Sep. 1, 2015, A13-14.
International Search Report and Written Opinion for PCT/EP2017/071674, mailed Dec. 14, 2017.
Fajardo, et al., "Bi-Specific T-cell Engager-Armed Oncolytic Adenoviruses as a Strategy to Improve Antitumor Efficacy", InHuman Gene Therapy, vol. 26, No. 9, pp. A13-A14, Sep. 1, 2015.
Champion, et al., "Delivery of Checkpoint Inhibitor Antibodies and Other Therapeutics Directly to Tumors by Encoding Them Within the Oncolytic Adenovirus Enadenotucirev", AACR 106th Annual Meeting 2015, Philadelphia, PA, vol. 75, Issue 15 Supplement, p. A295, Apr. 18, 2015.
Champion, et al., ""Arming" the Chimeric Oncolytic Adenovirus Enadenotucirev to Deliver Checkpoint Inhibitors and Other Therapeutics Directly to Tumours", Journal for Immunotherapy of Cancer, vol. 2, No. Suppl. 3, p. P46, Jan. 1, 2014.
Raum, et al., "Novel Primate-Crossreactive BiTE Antibodies that Eliminate Cancer Cells Expressing cMet, IGFR-1, FAP-alpha, PSCA, Endosialin, CAIX or Her2/neu", Proceedings of the Annual Meeting of the American Association for Cancer Research, vol. 51, p. 590, Apr. 15, 2010.
Freedman, et al., "Oncolytic Adenovirus Expressing Bispecific Antibody Targets T-cell Cytotoxicity in Cancer Biopsies", EMBO Molecular Medicine, vol. 9, No. 8, pp. 1067-1087, Jun. 20, 2017.
Garcia-Carbonero, et al., "Phase 1 Study of Intravenous Administration of the Chimeric Adenovirus Enadenotucirev in Patients Undergoing Primary Tumor Resection", Journal for Immunotherapy of Cancer, vol. 5, No. 1, pp. 1-13, Sep. 19, 2017.

\* cited by examiner

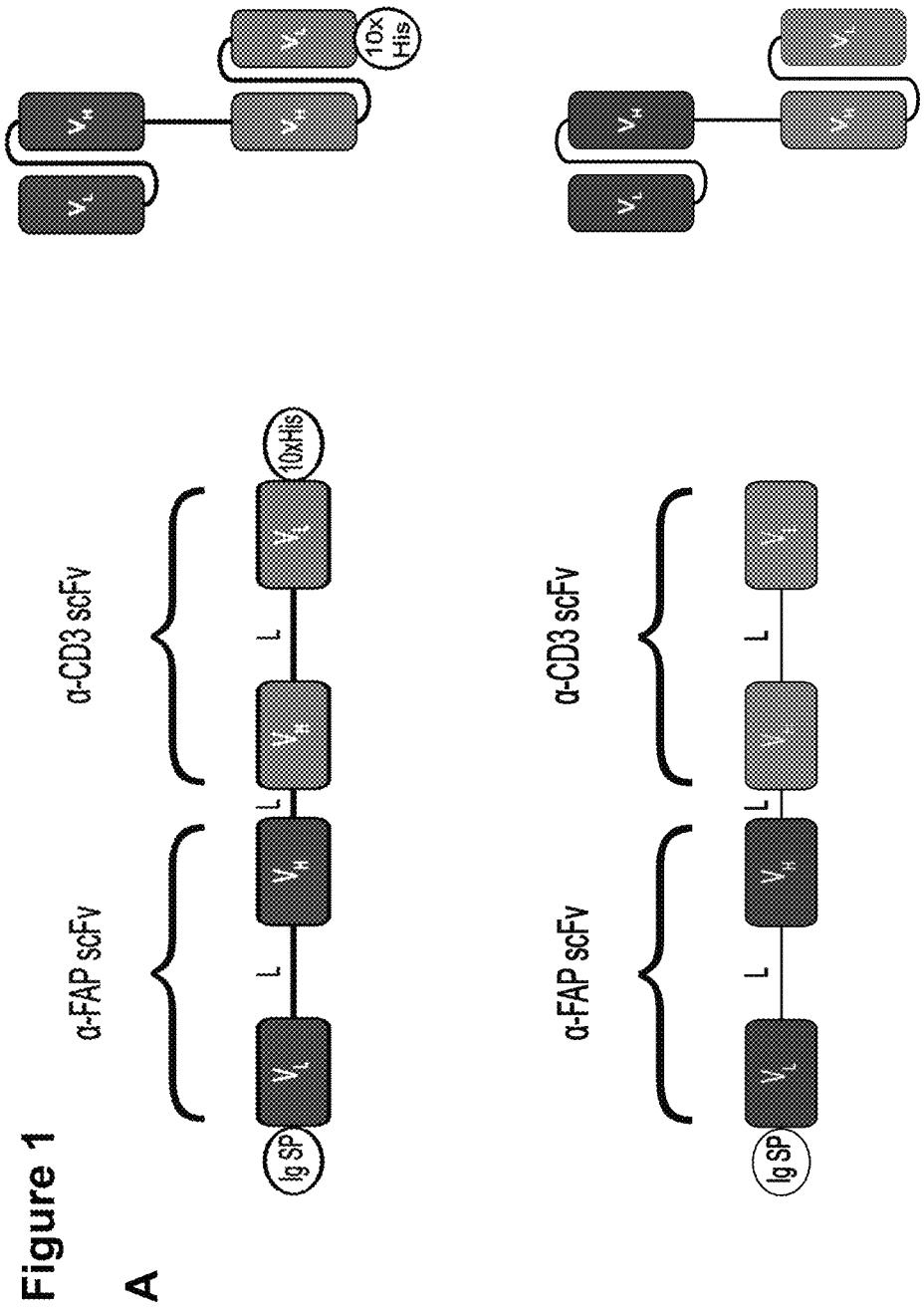

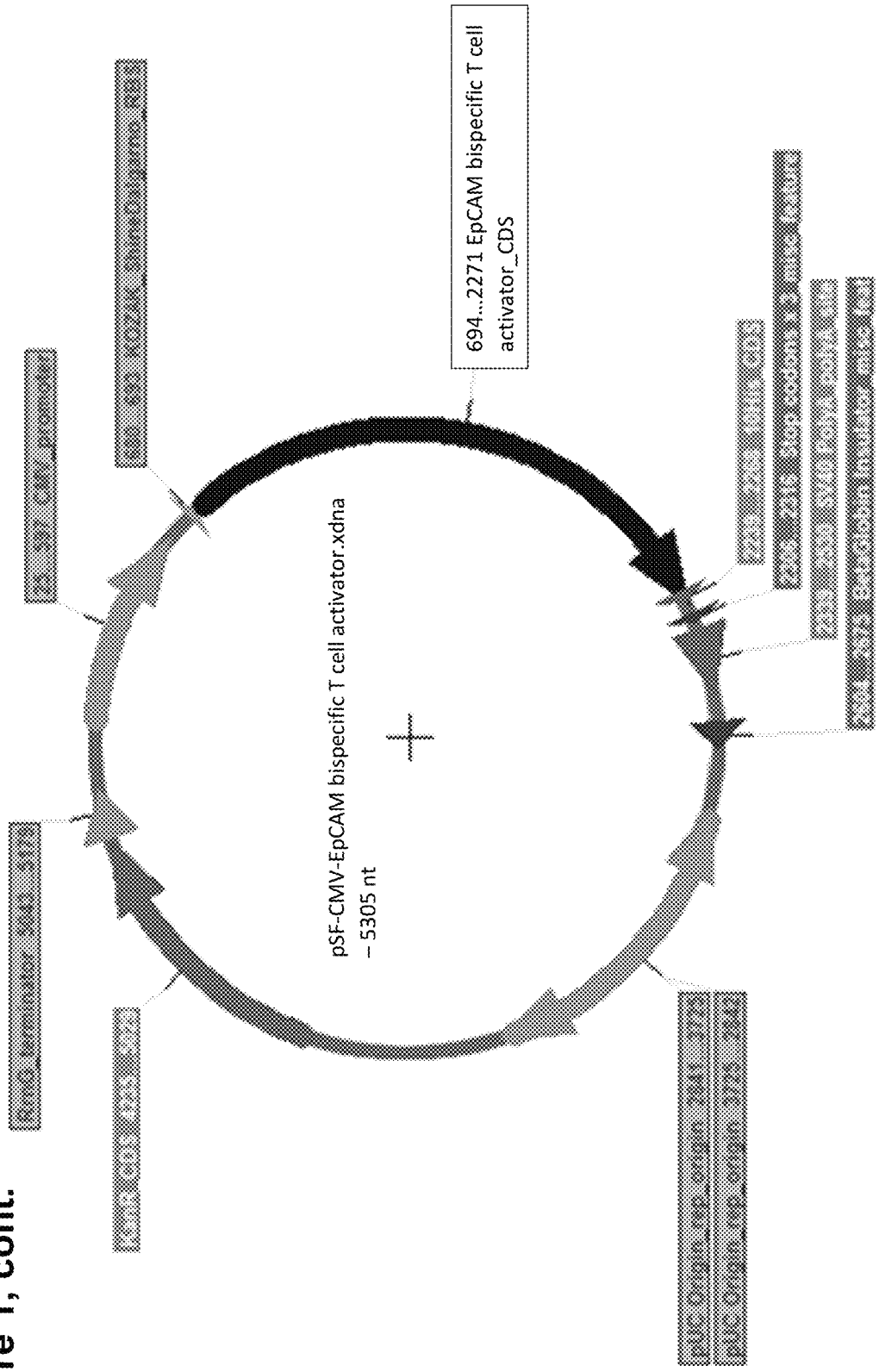
Figure 1, cont.
B

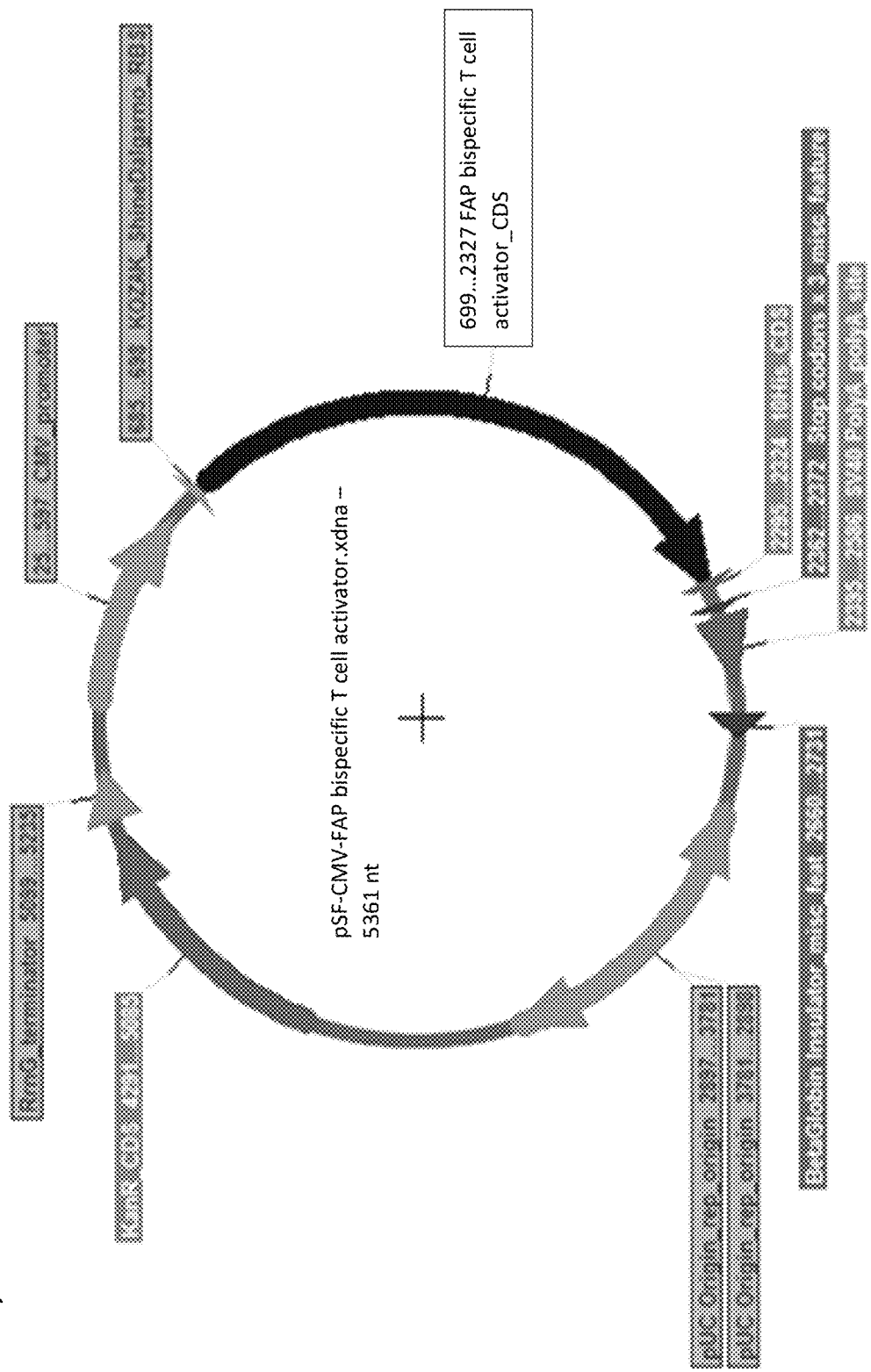
Figure 1, cont.
C

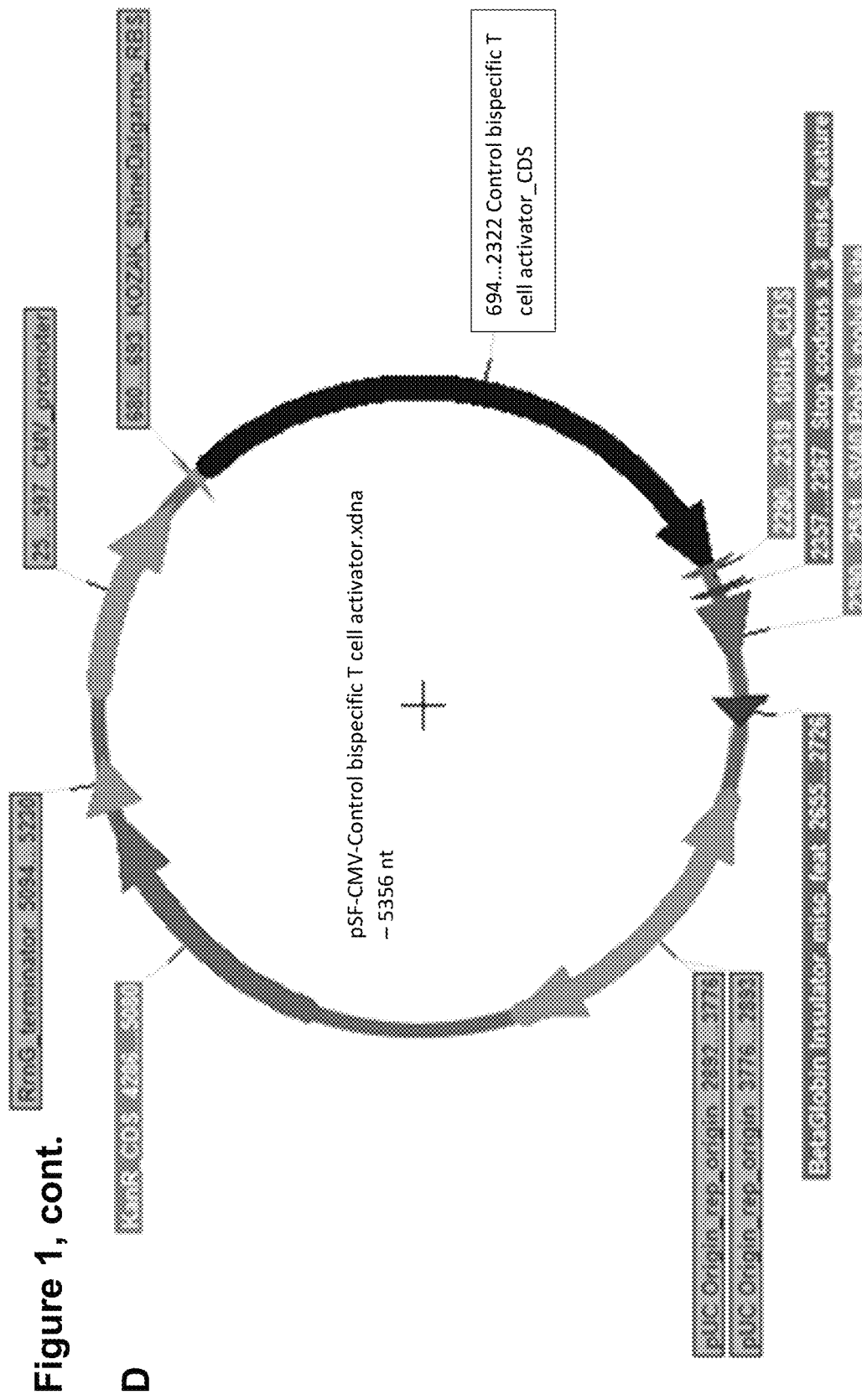
Figure 1, cont.
D

Figure 2
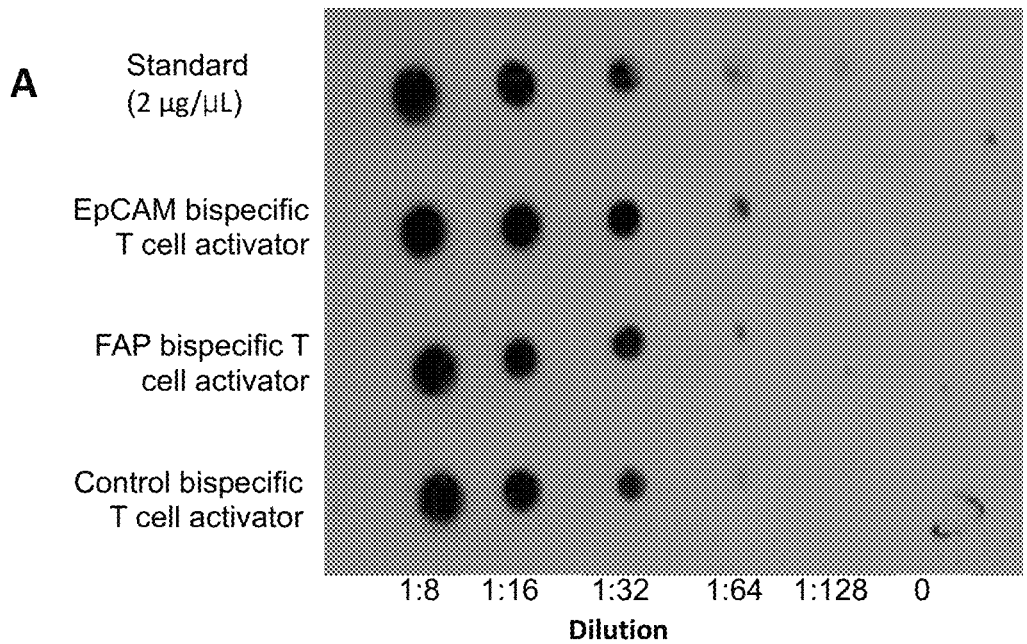
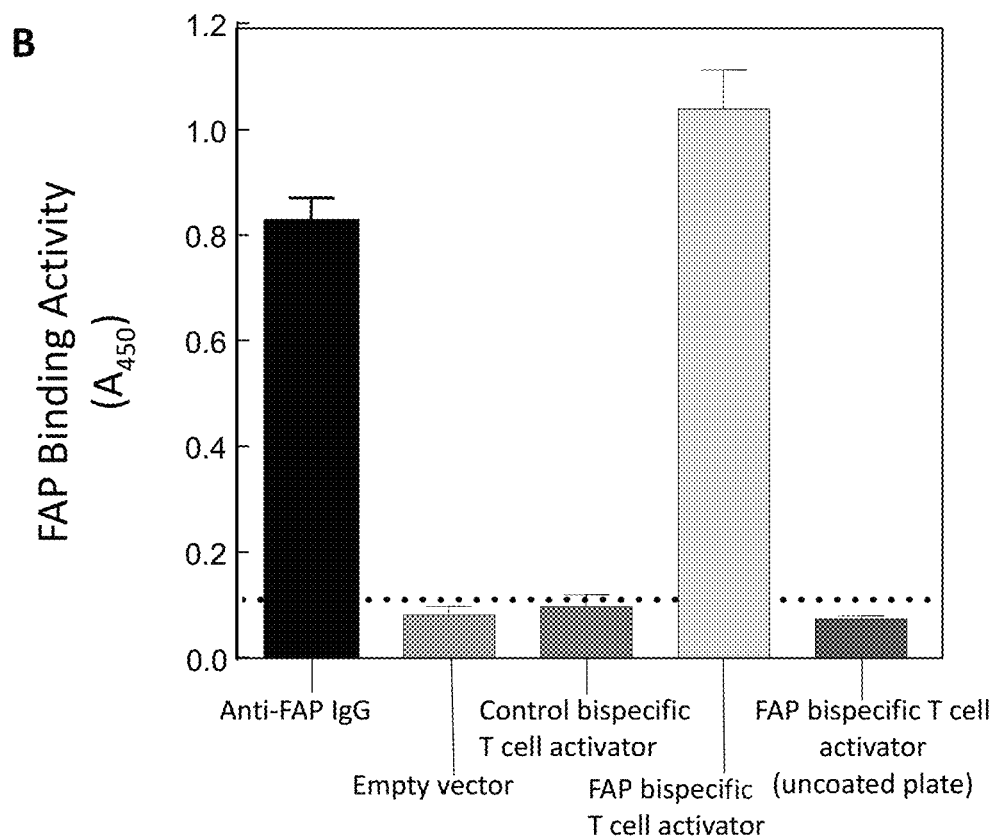

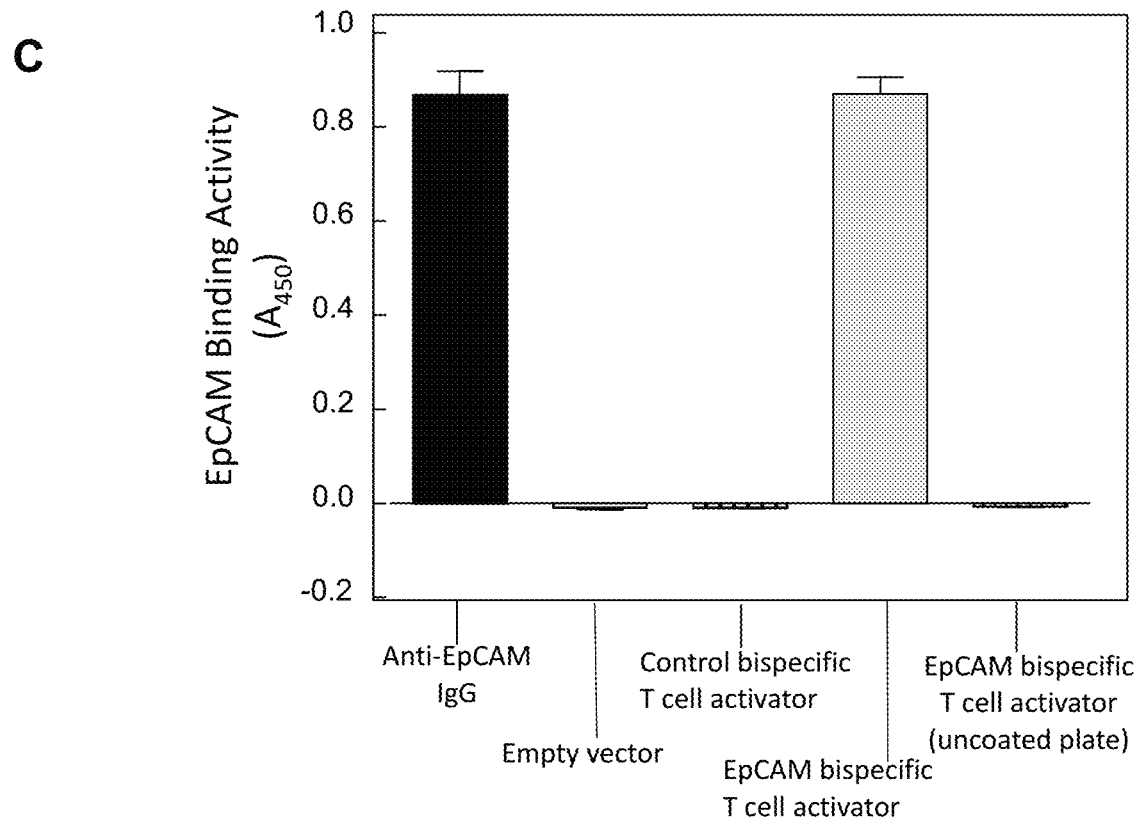
Figure 2, cont.

Figure 3
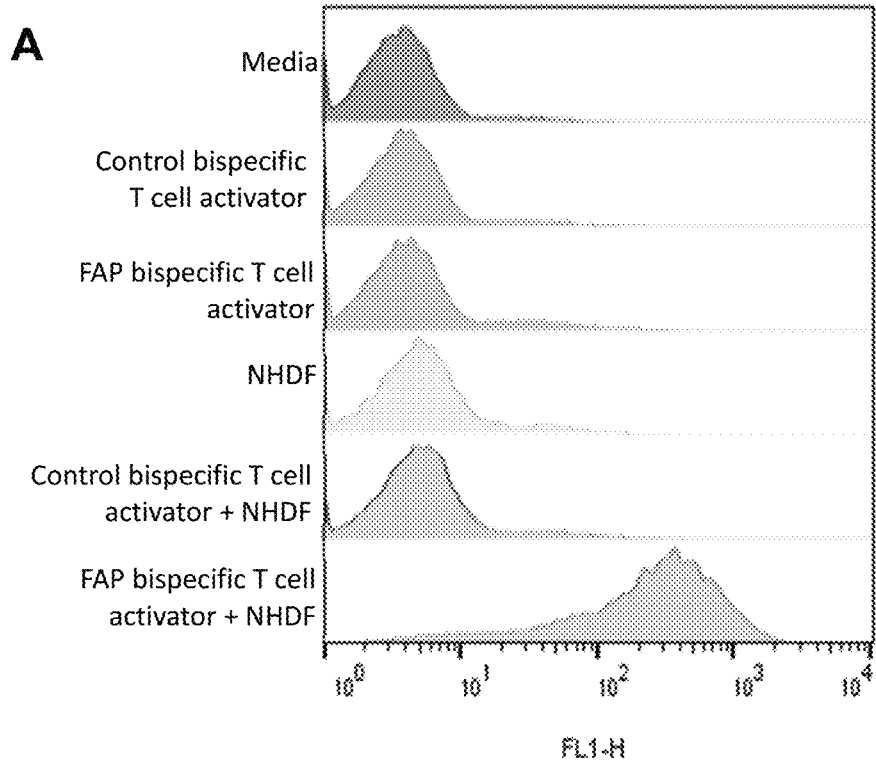
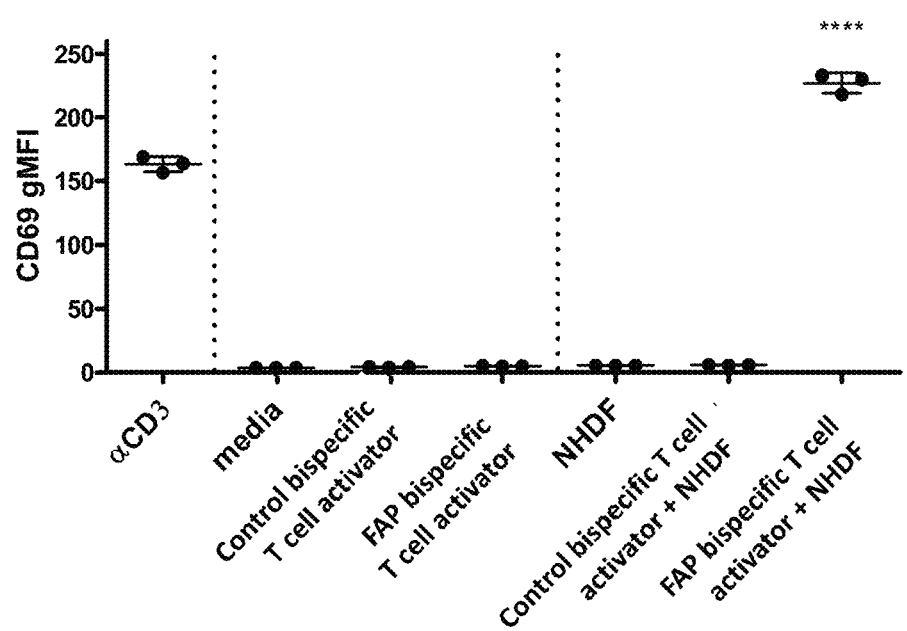

Figure 3, cont.
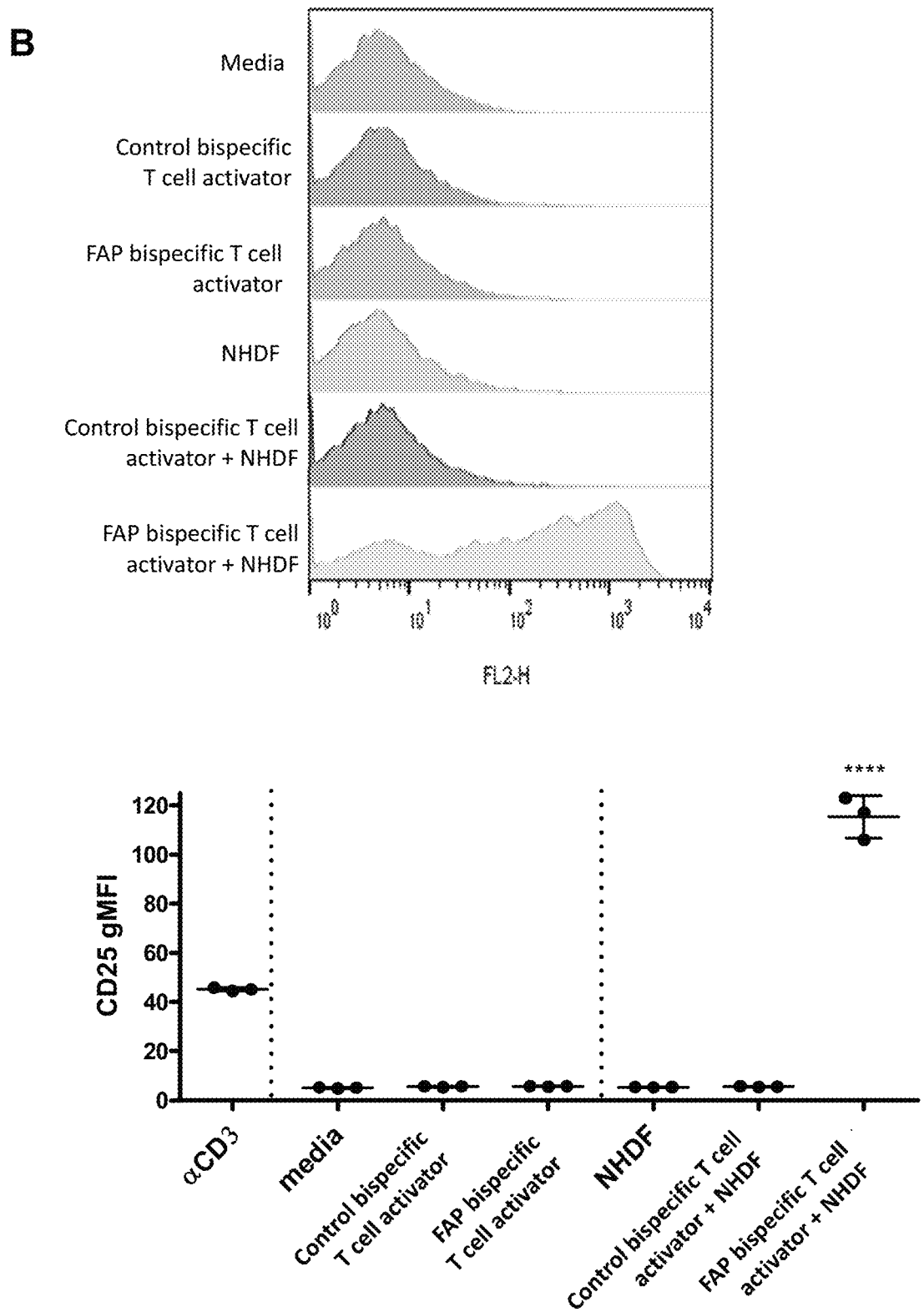

Figure 4
A
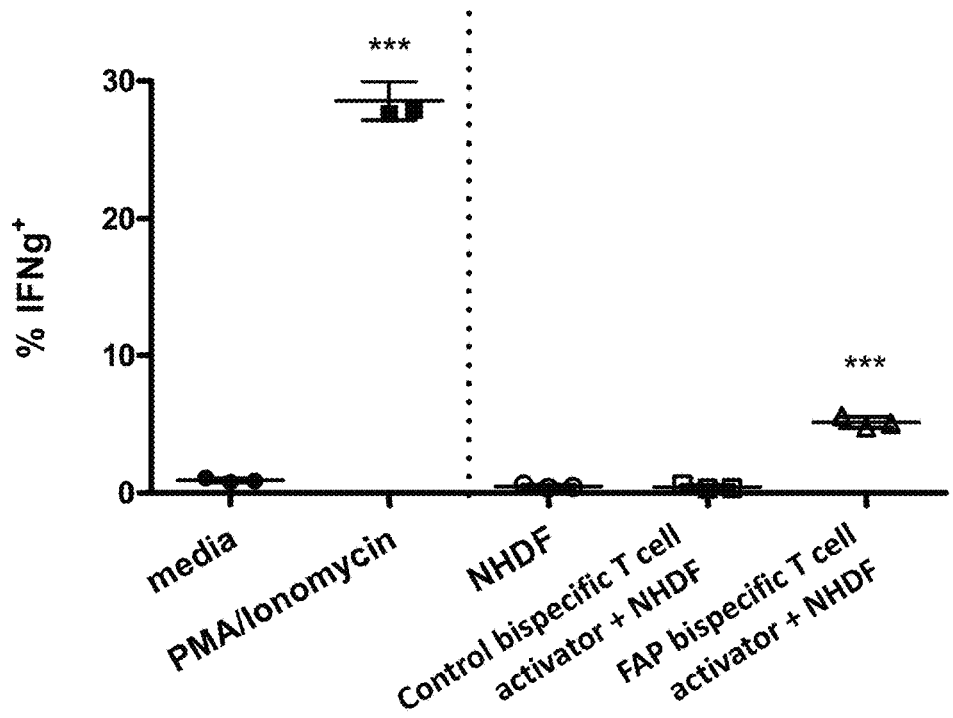
B
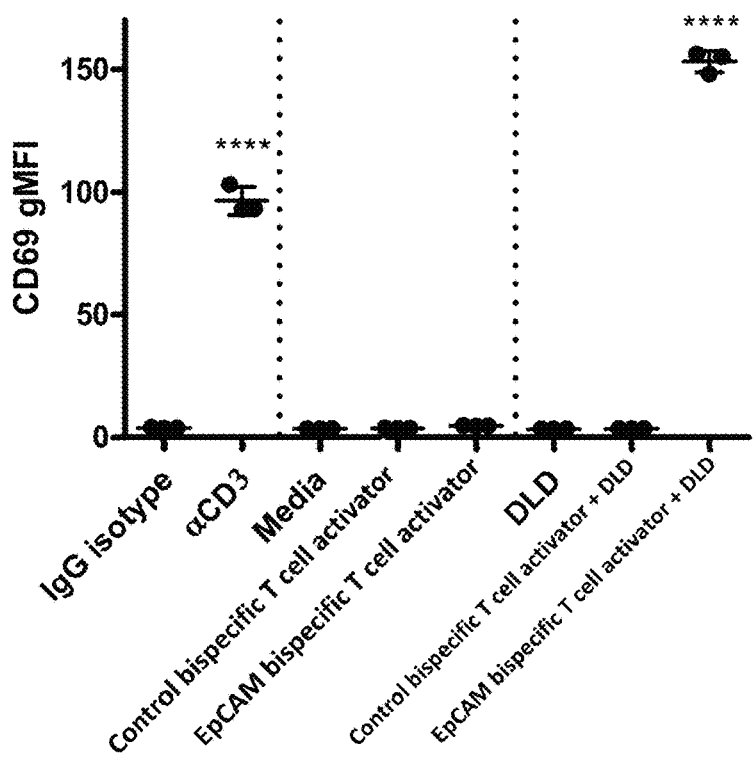

Figure 4, cont.
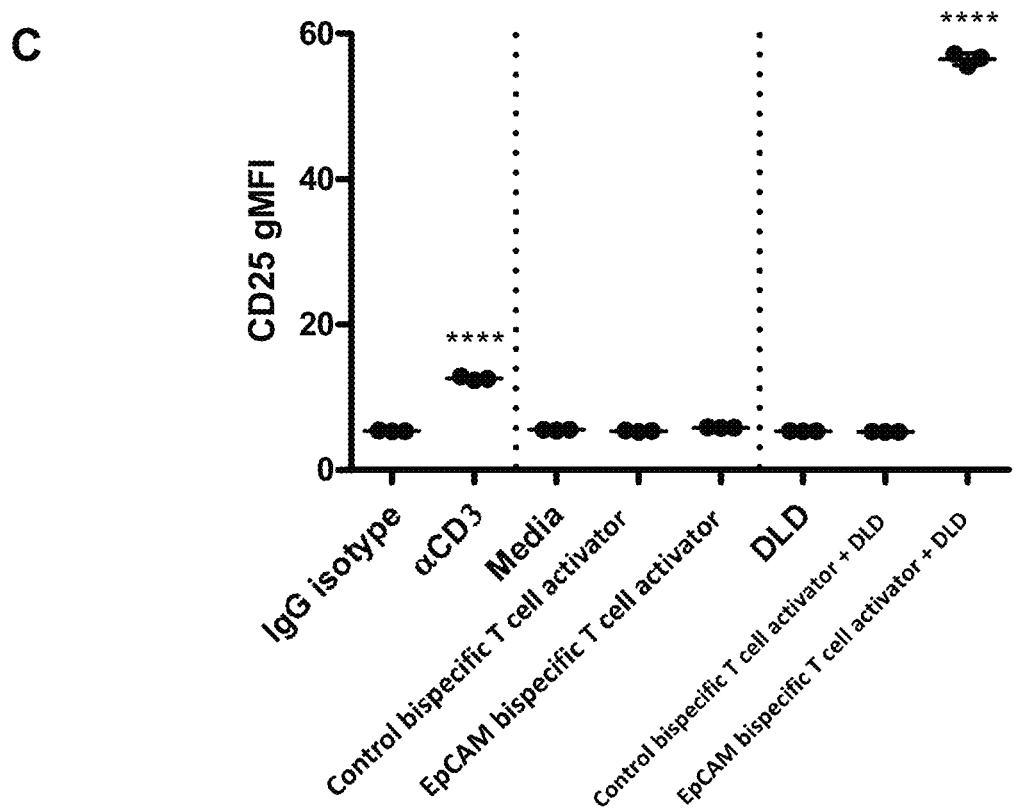
Figure 5
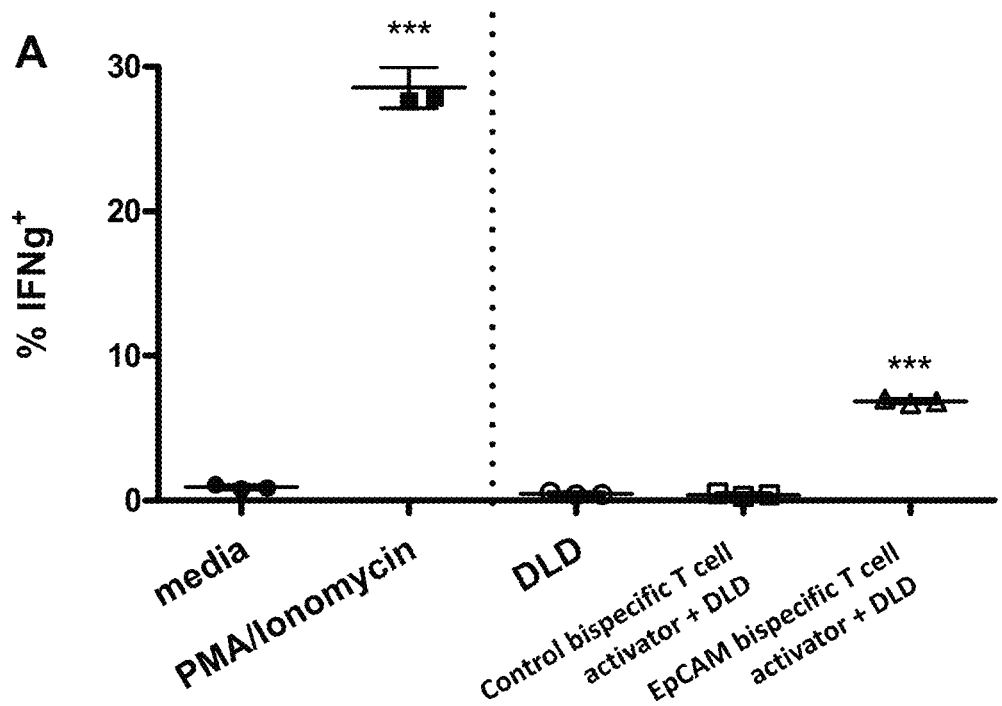

FIGURE 5, cont.
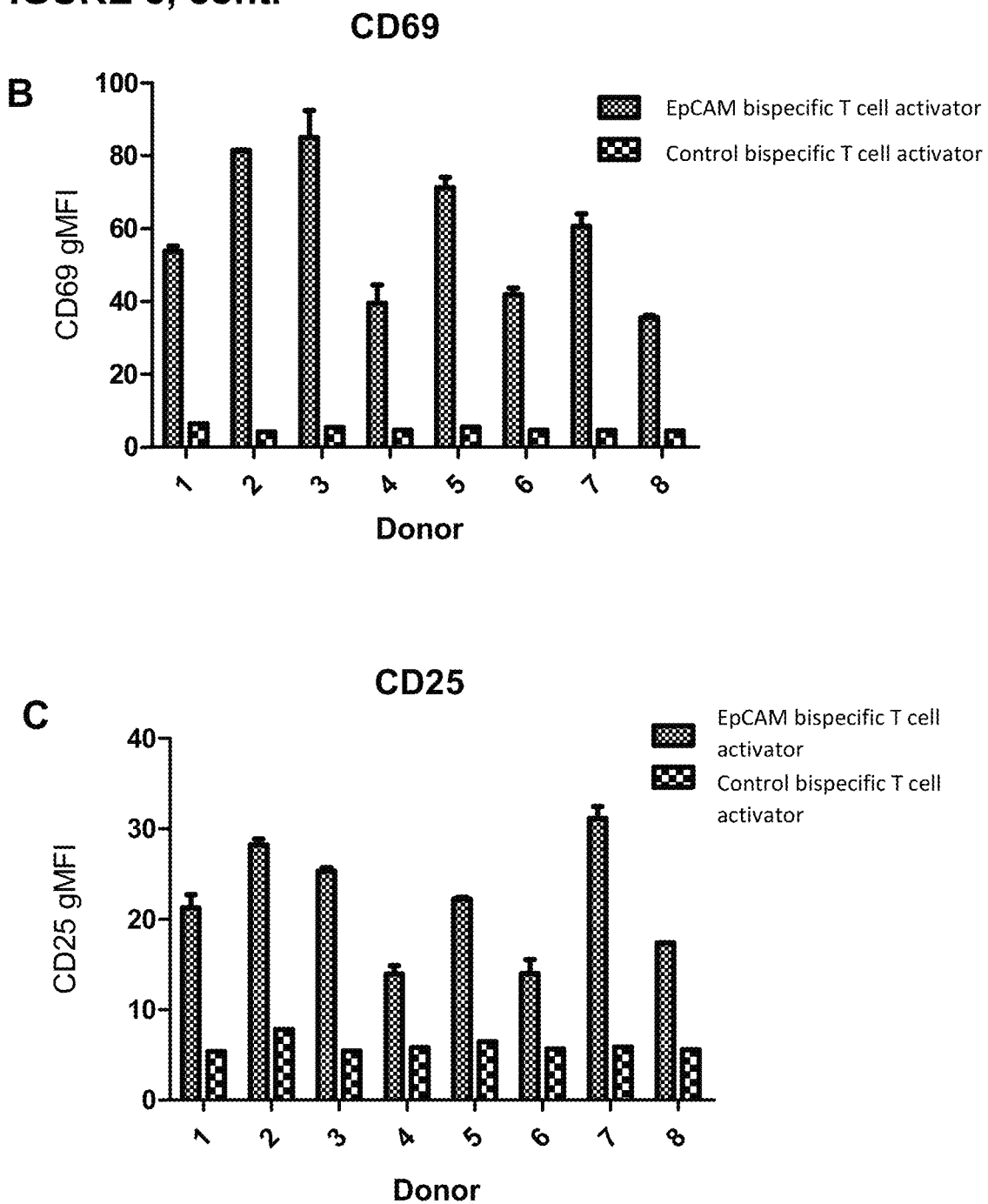

Figure 7A
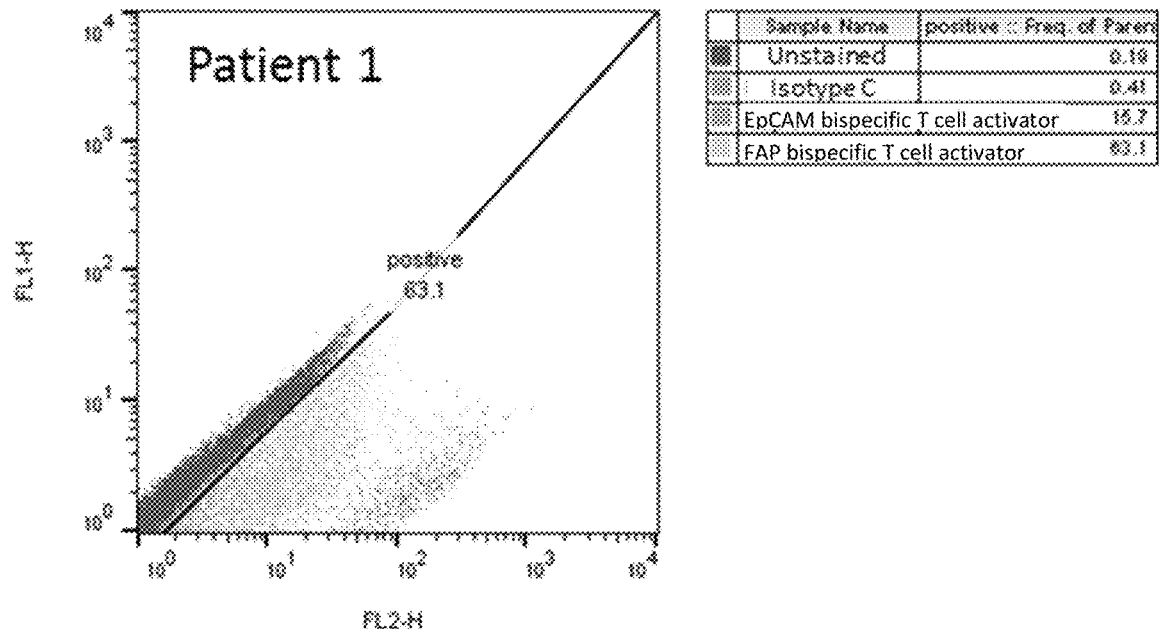
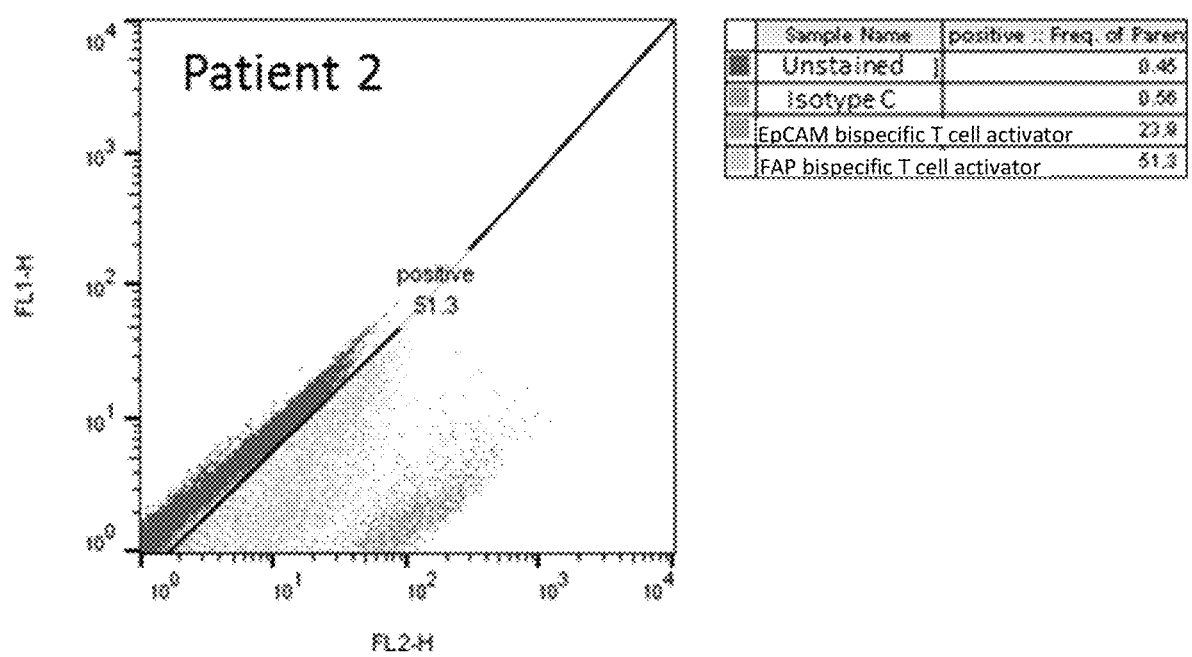

Figure 7A, cont.
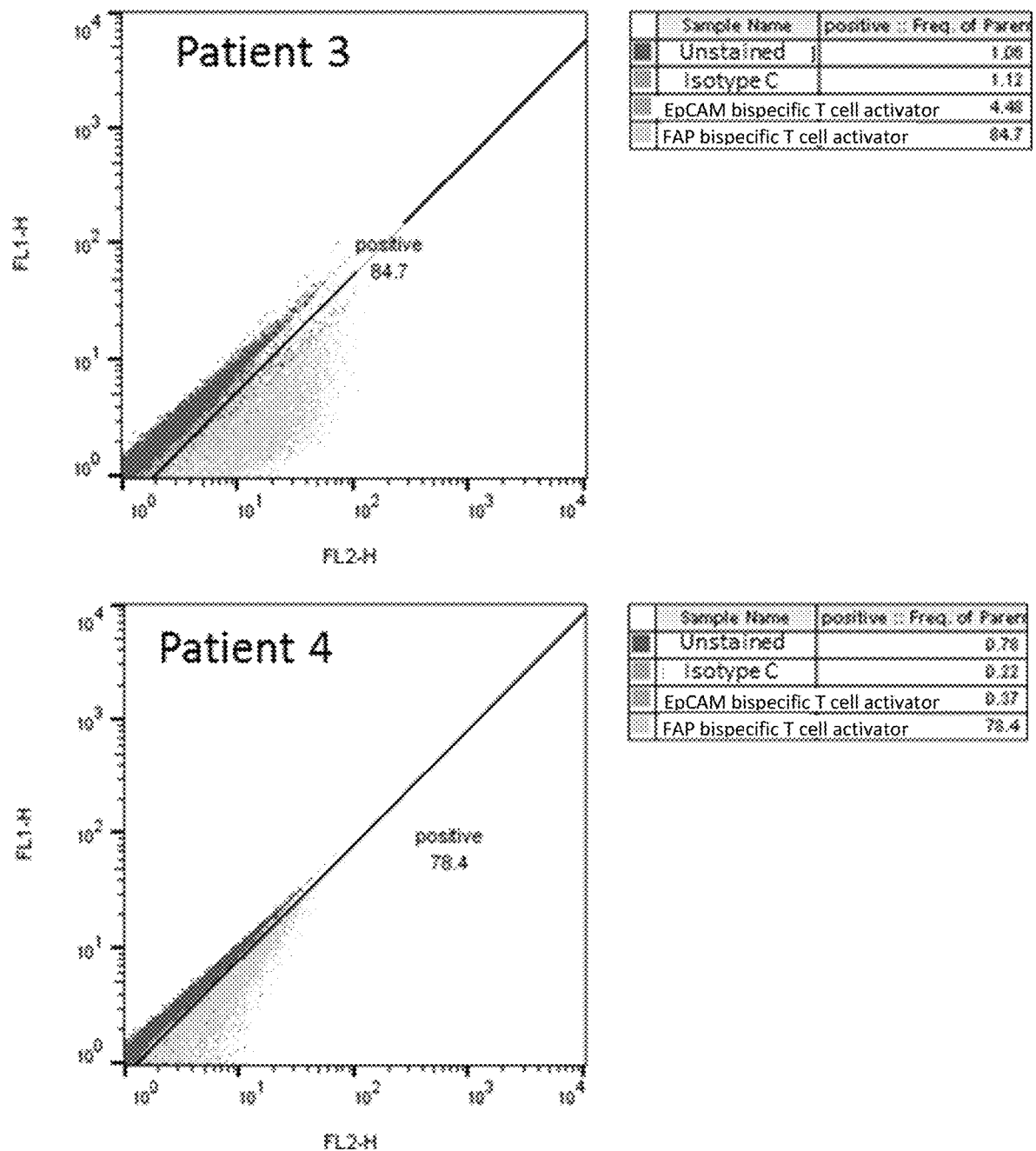

Figure 8, cont.
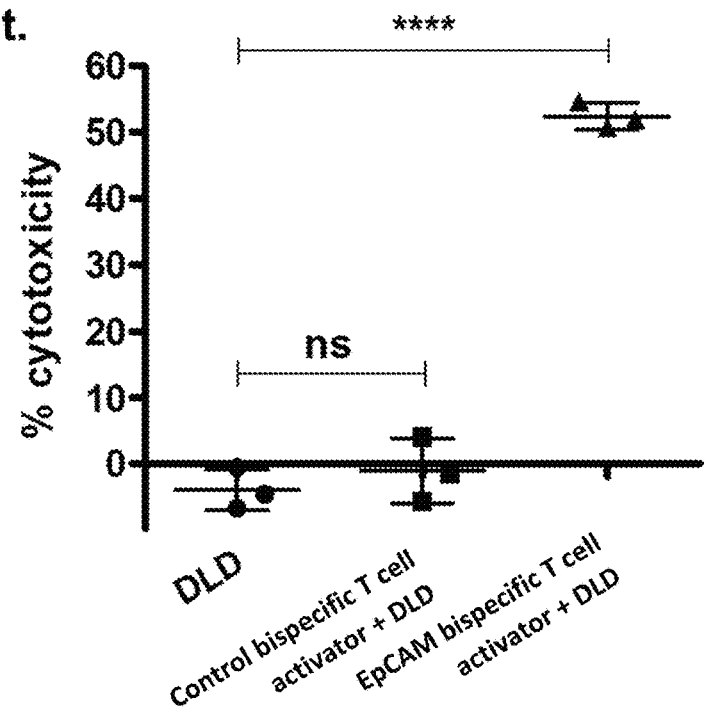
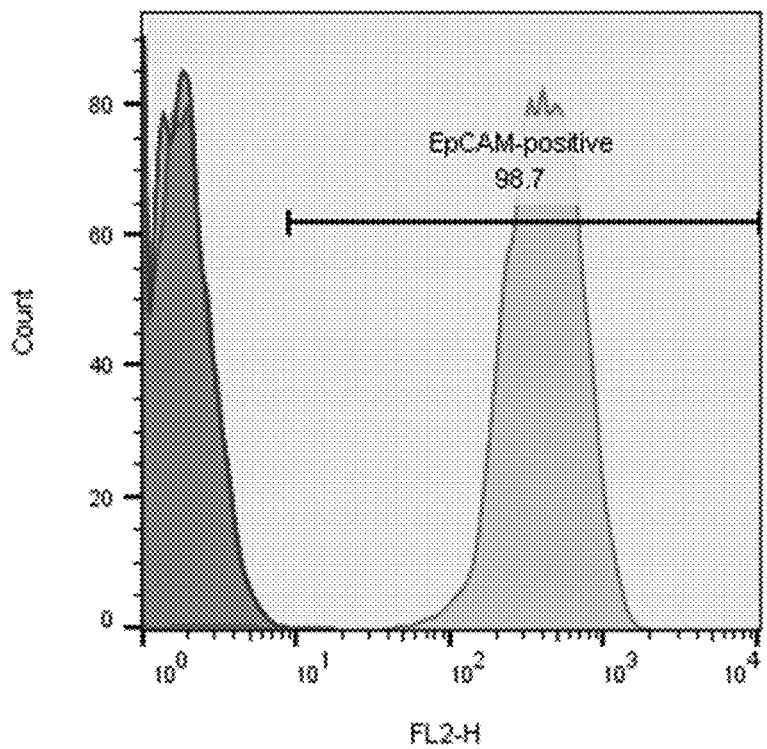

Figure 9
A
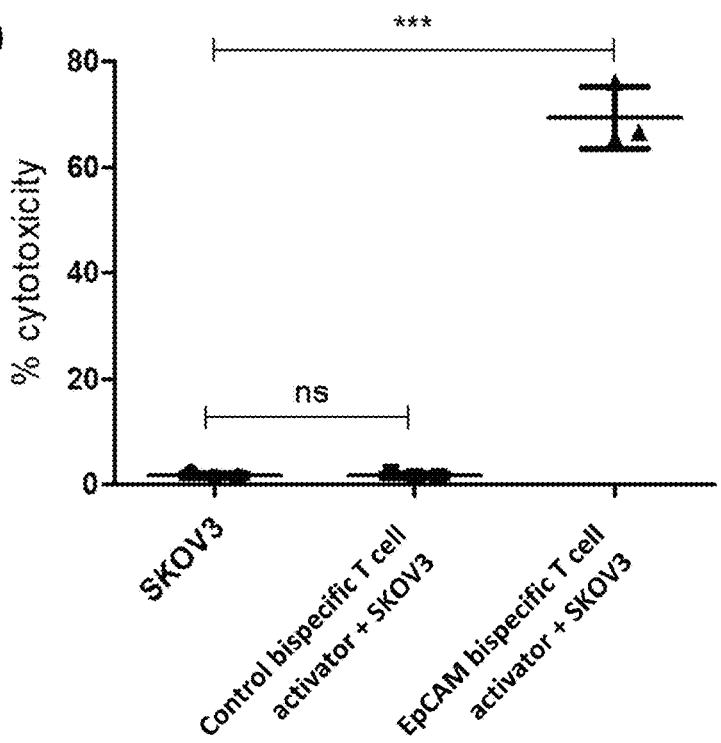
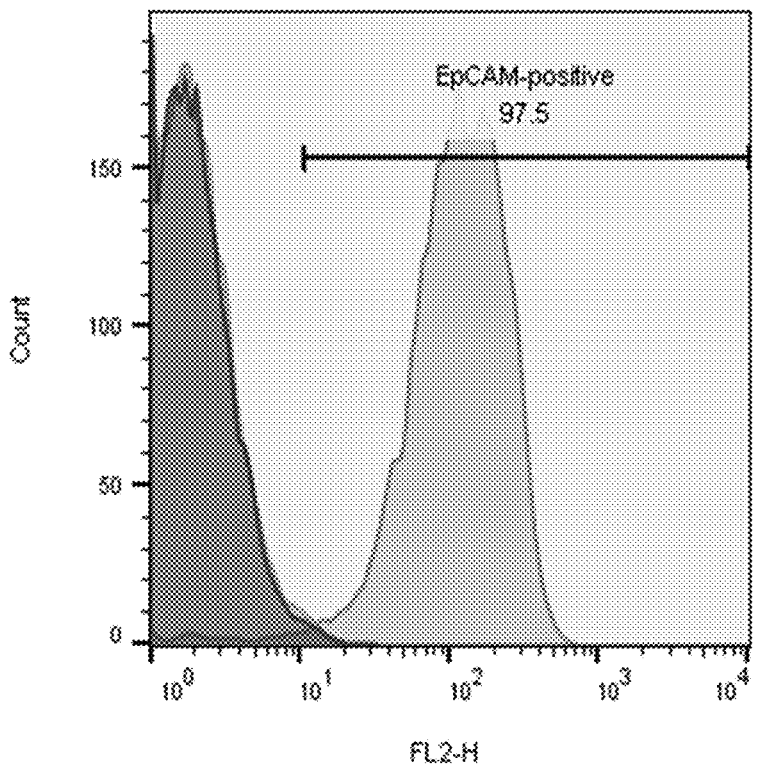

Figure 9, cont.
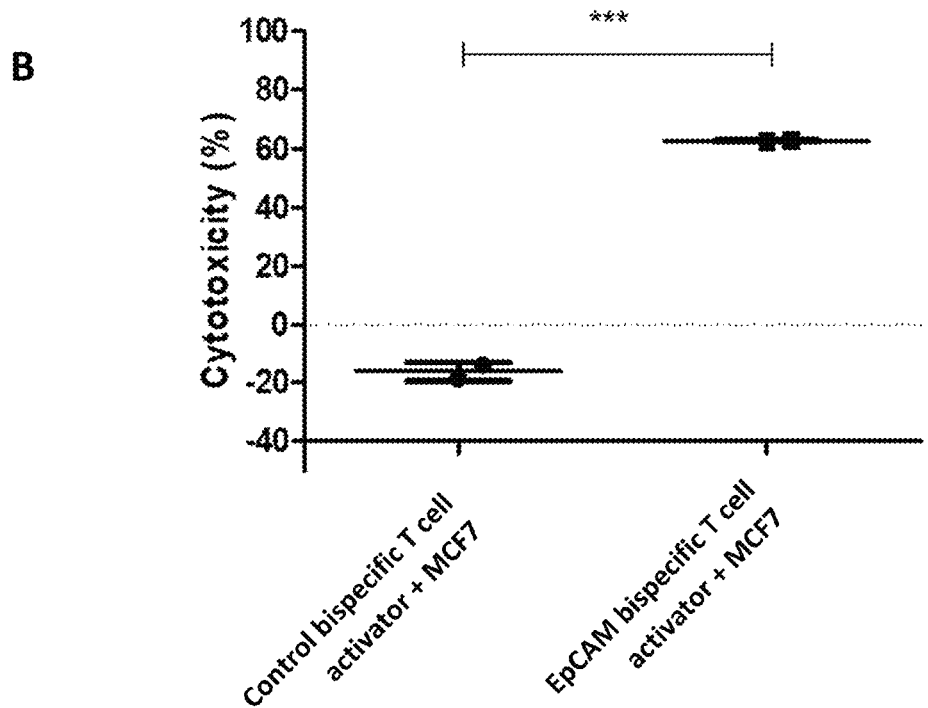
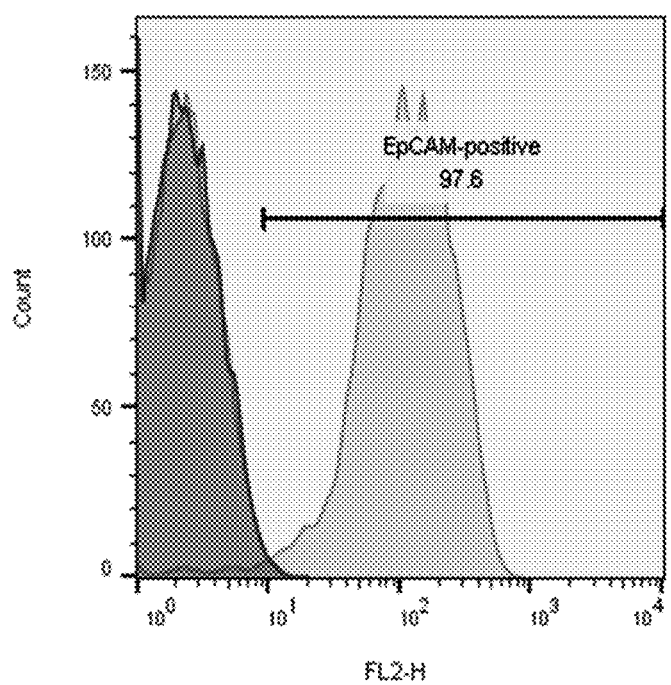

Figure 12
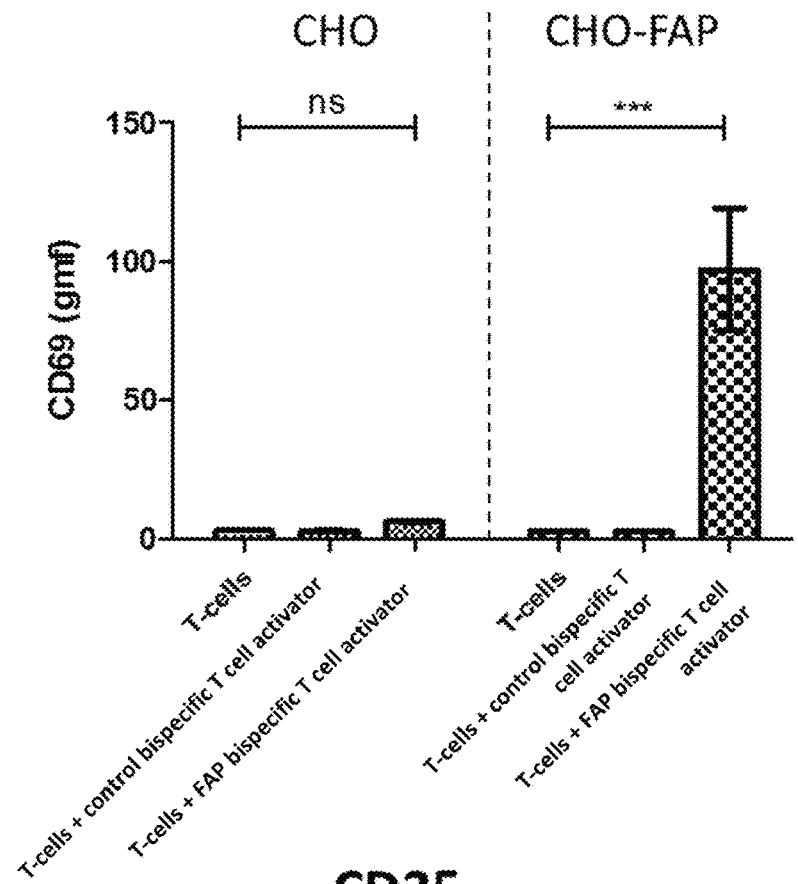
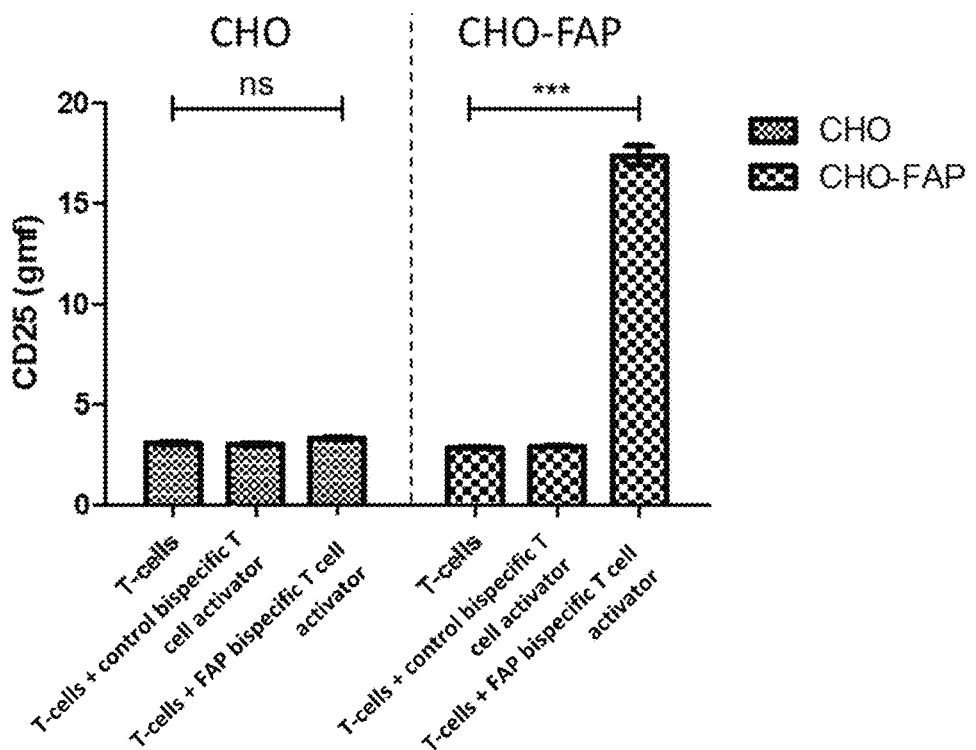

Figure 13
A
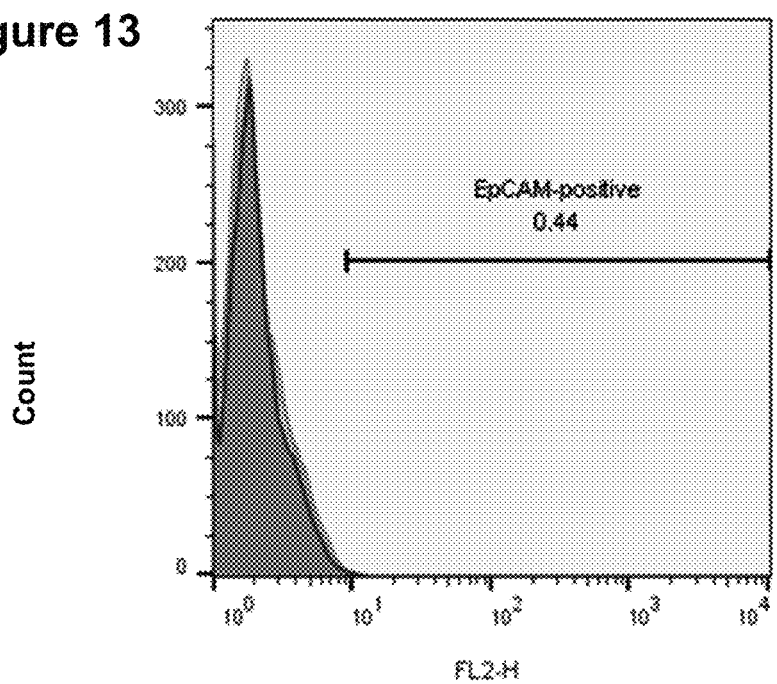
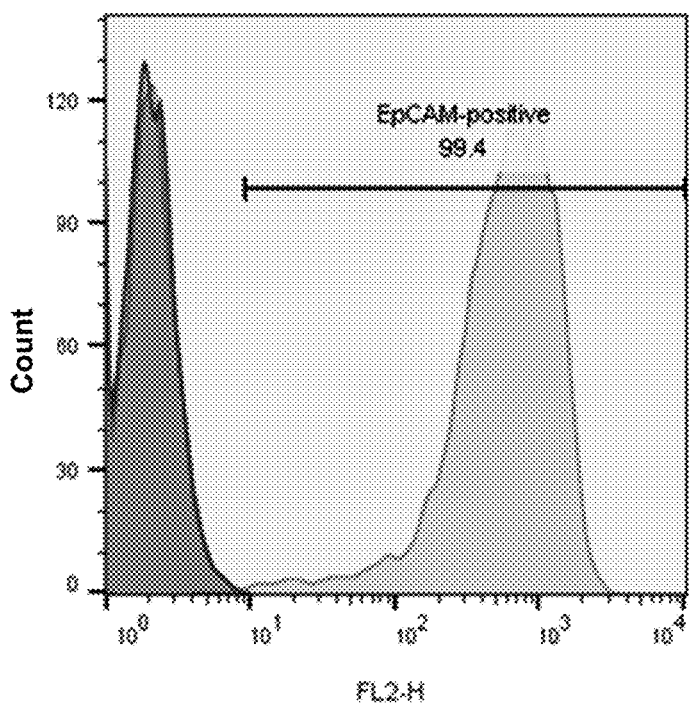

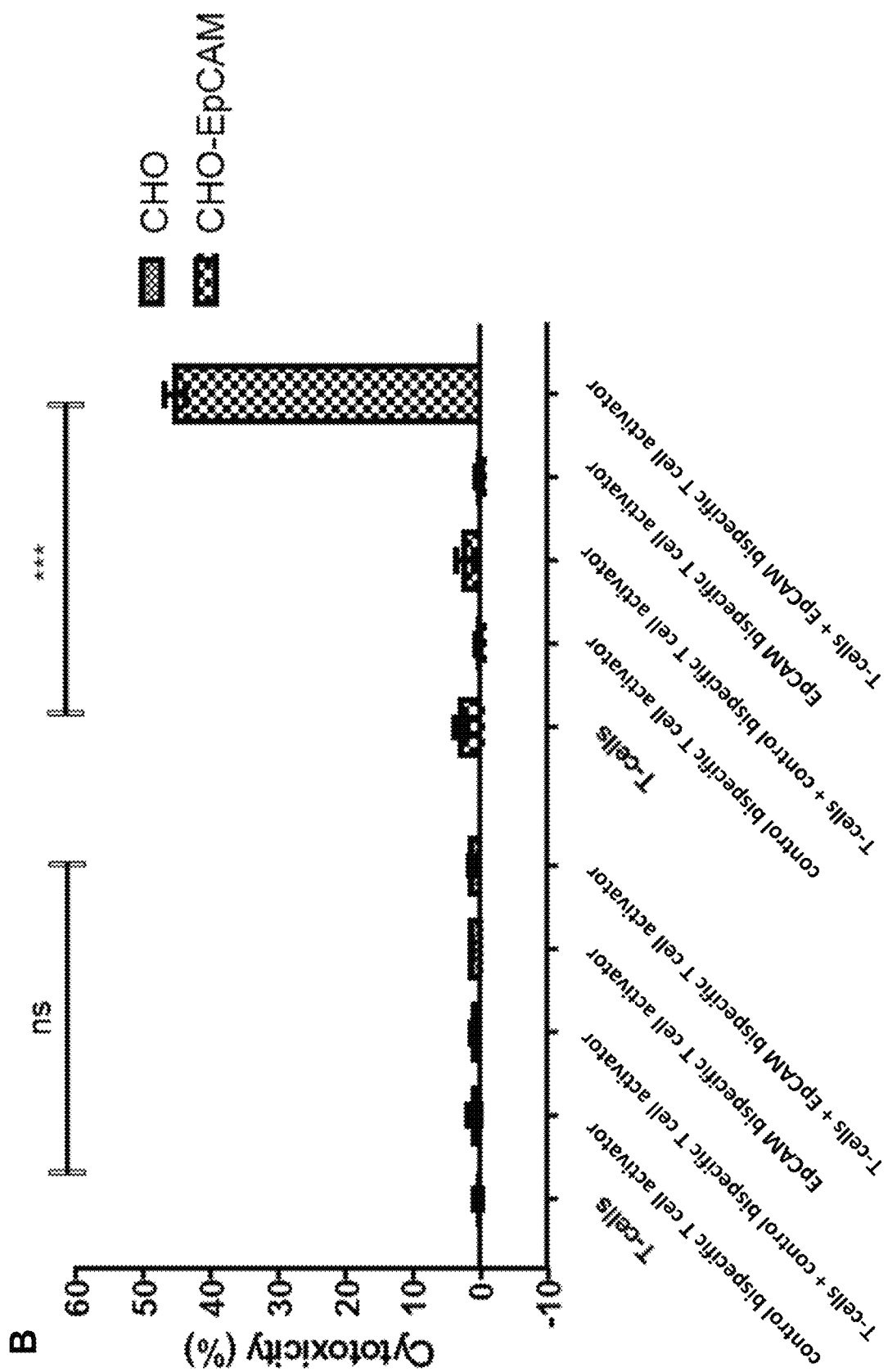
Figure 13, cont.

Figure 14
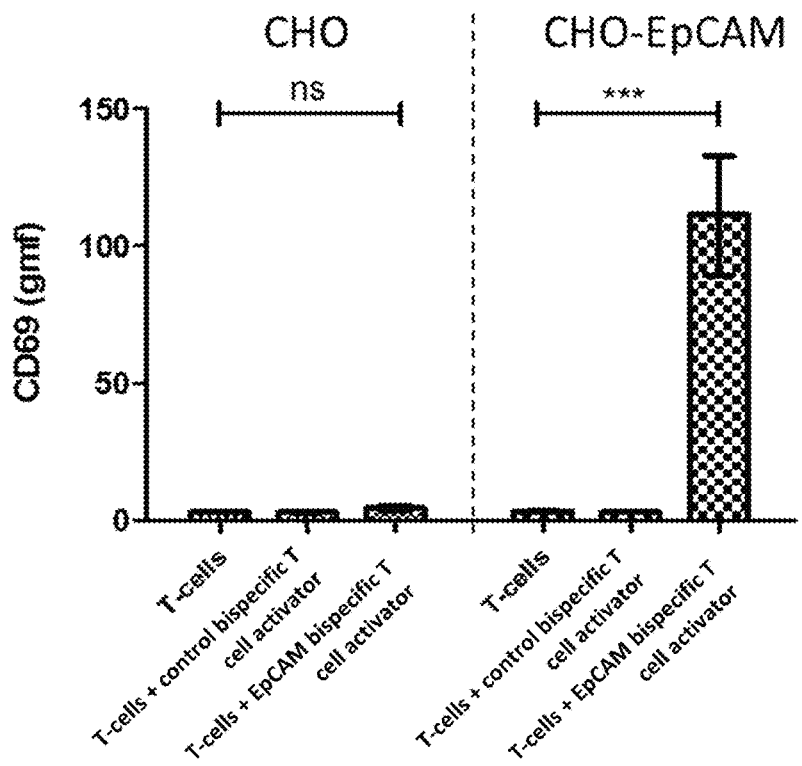
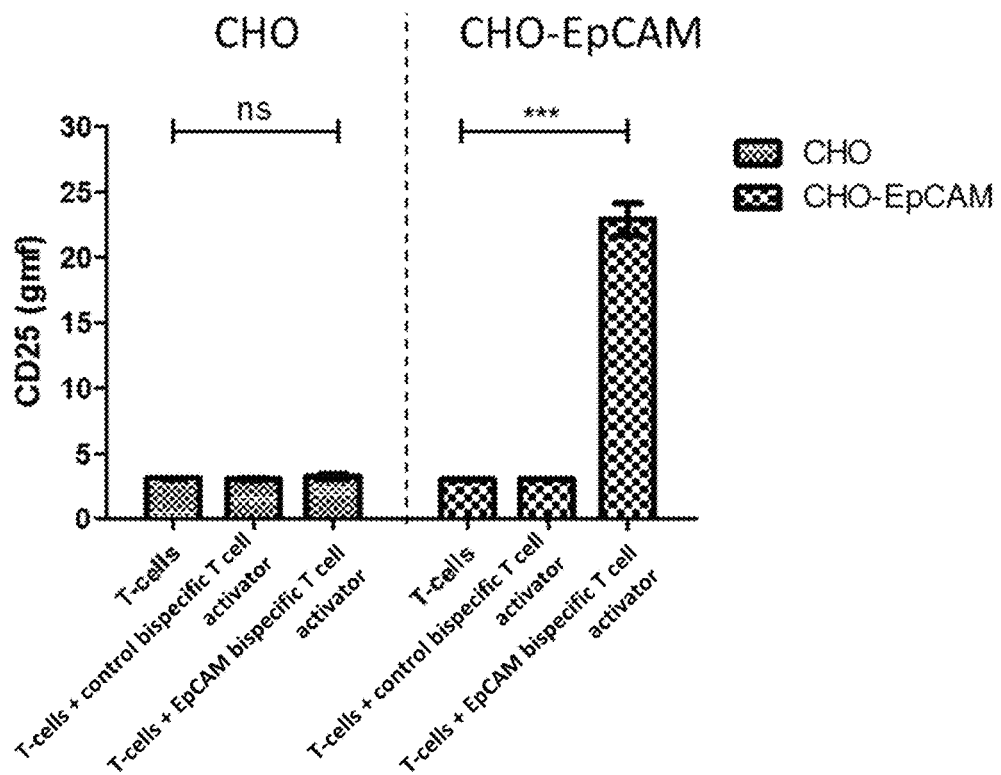

Figure 16
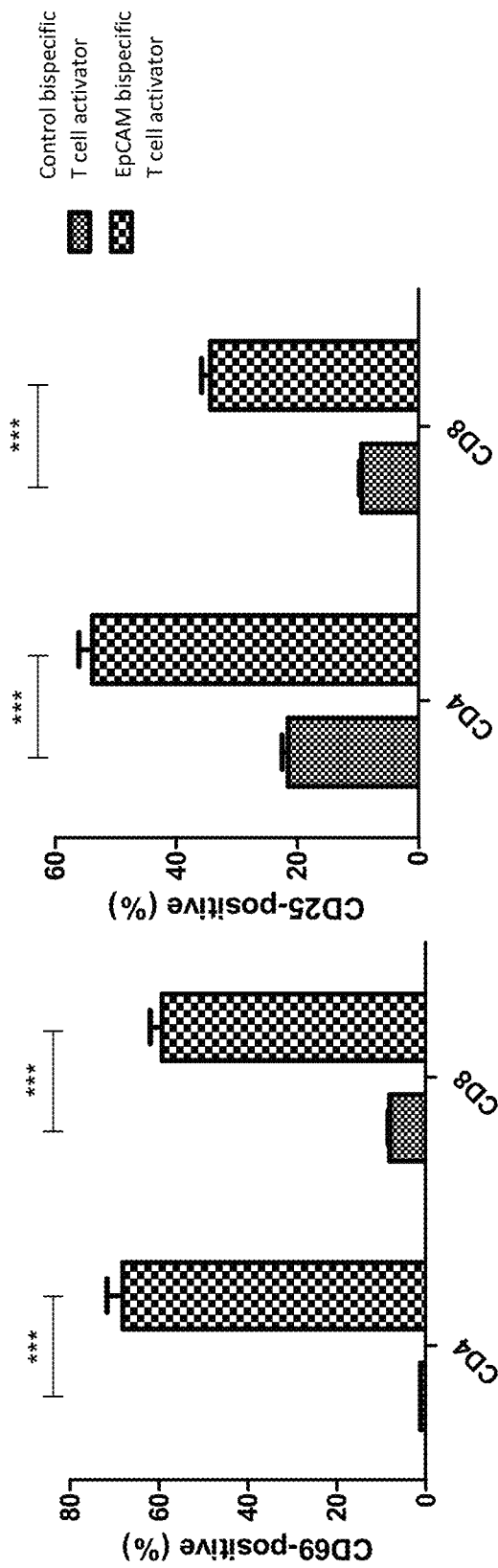
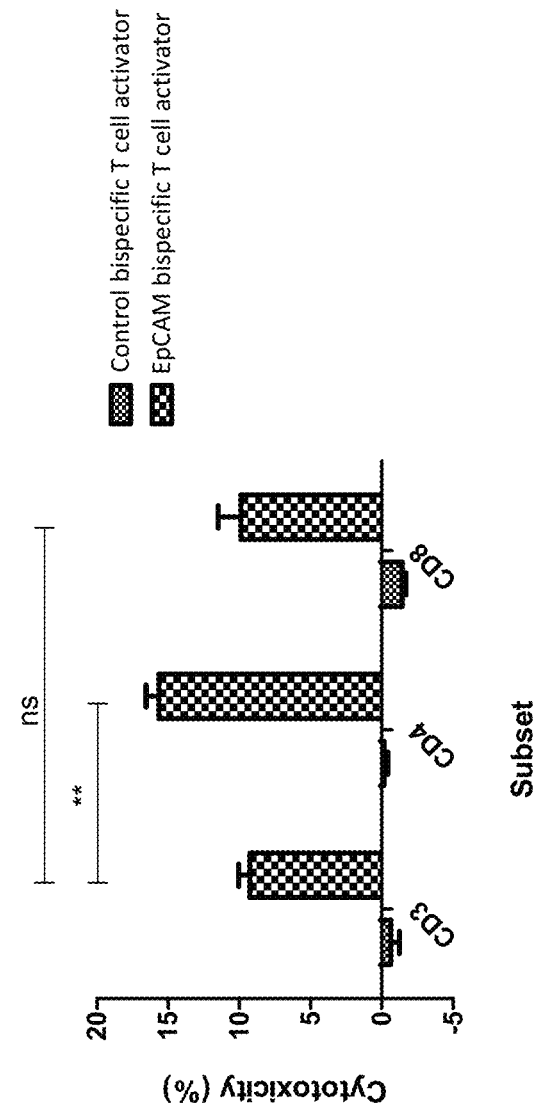

Figure 20, cont.
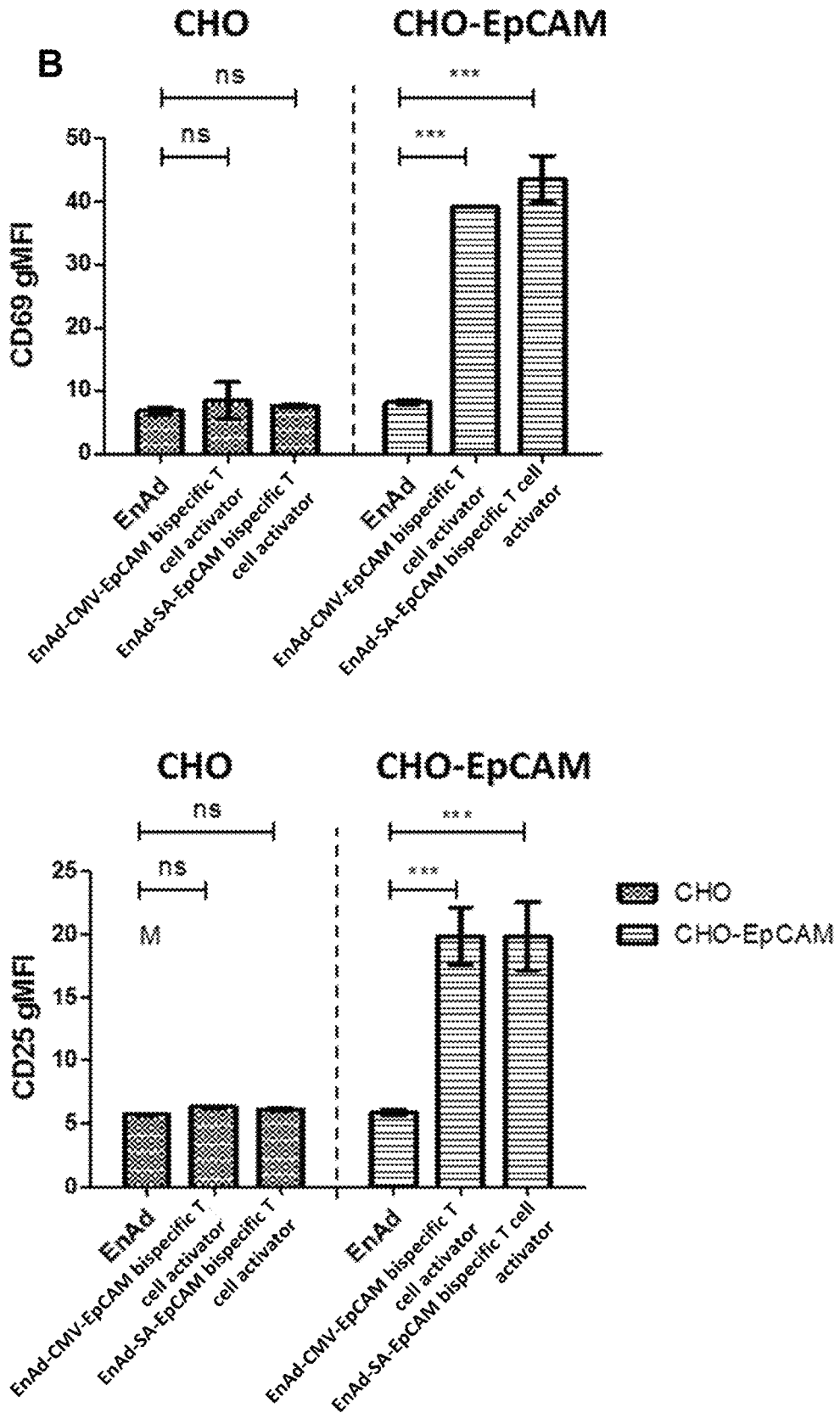

Figure 21
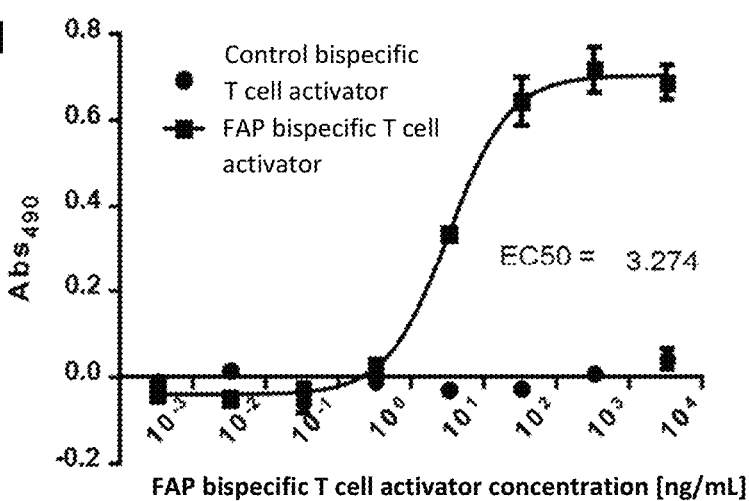
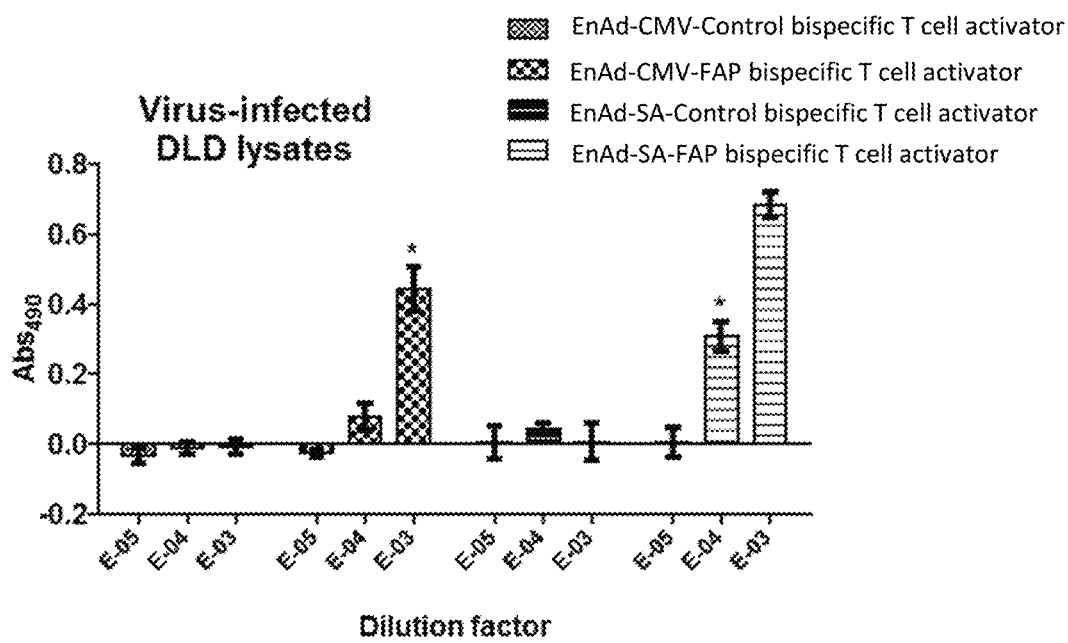
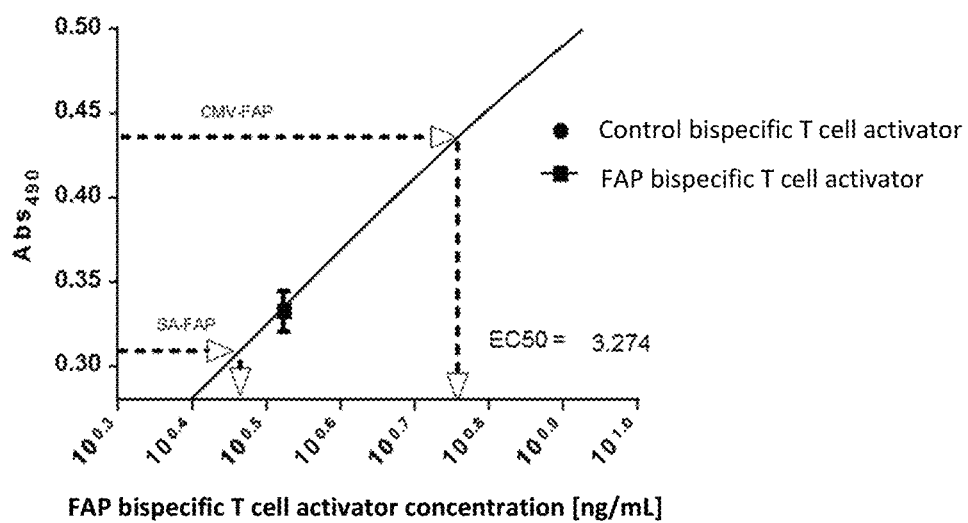

Figure 29
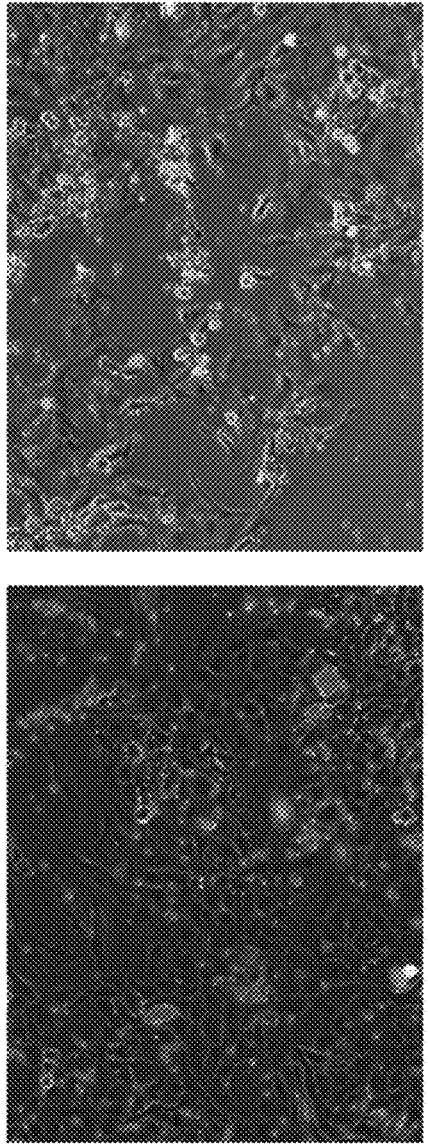
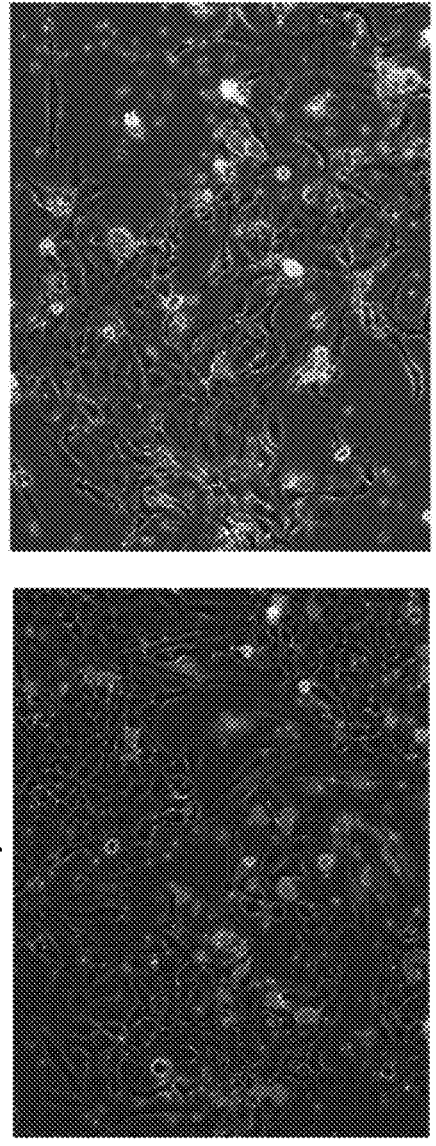
- SKOV (unstained)
- NHDF (green)
- RFP virus (red) – MOI of 1 for CMV, 10 for SA

Figure 33
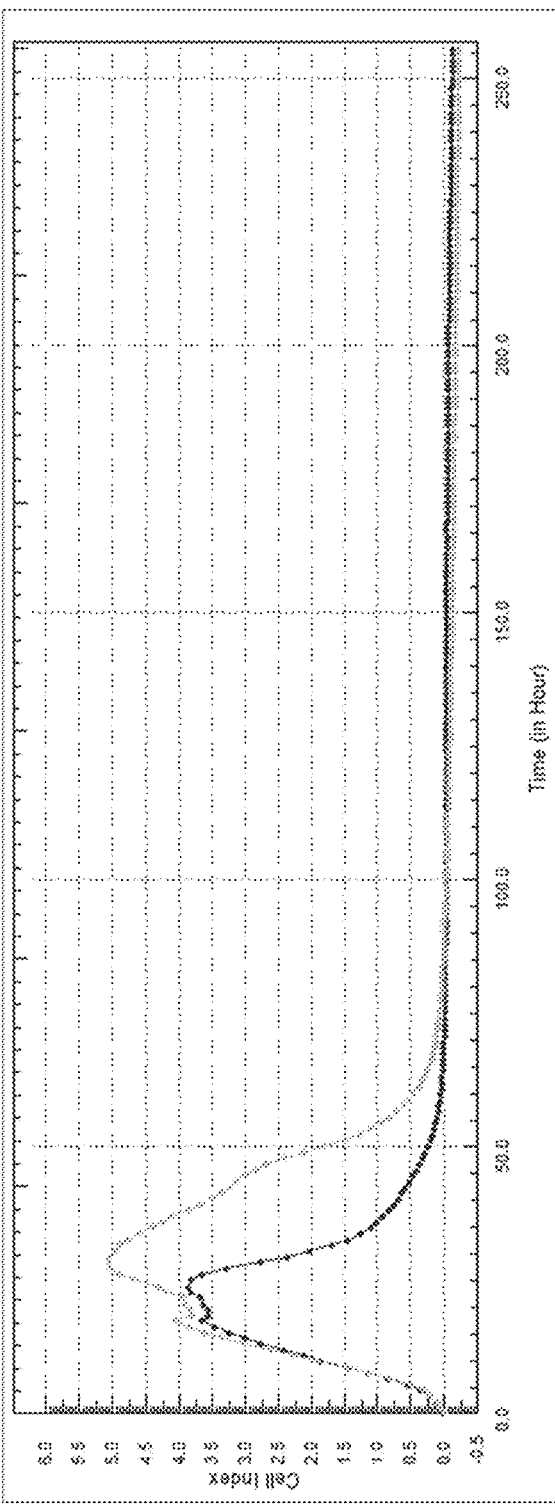
MOI: 10
Light grey – no T-cells added
Dark grey – T-cells added
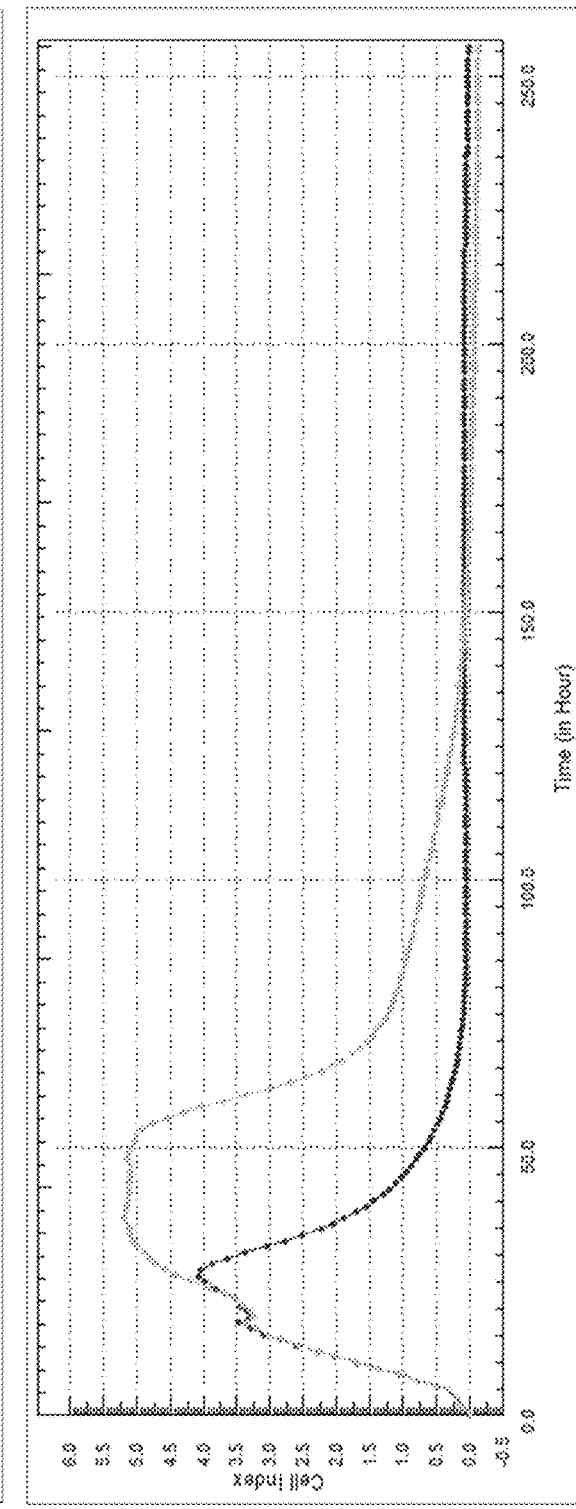
MOI: 1

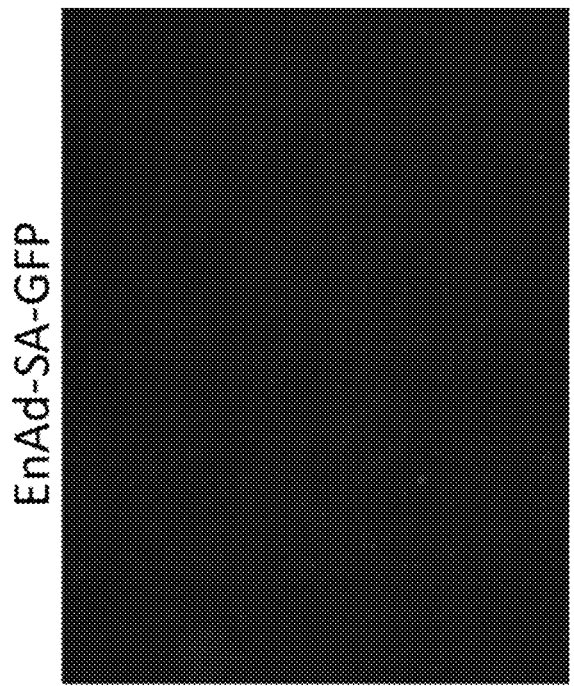
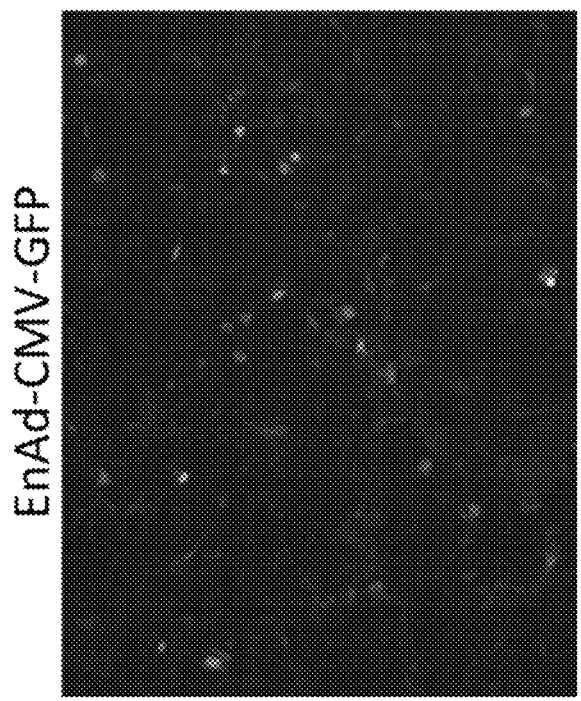
Figure 39

Figure 41
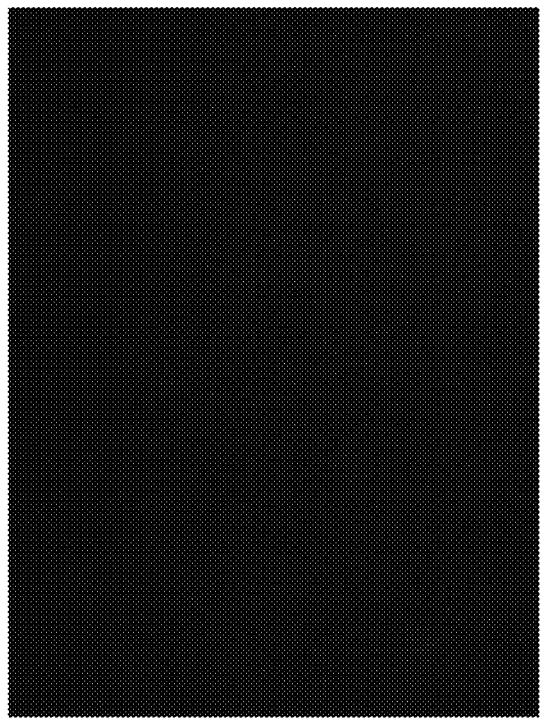
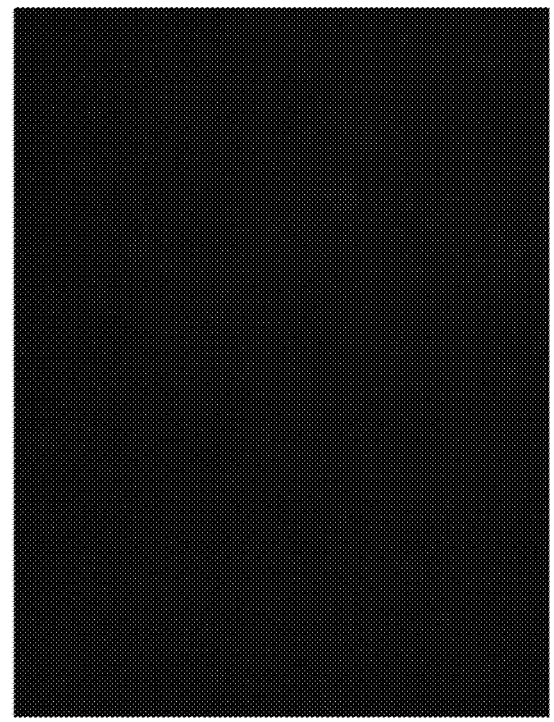
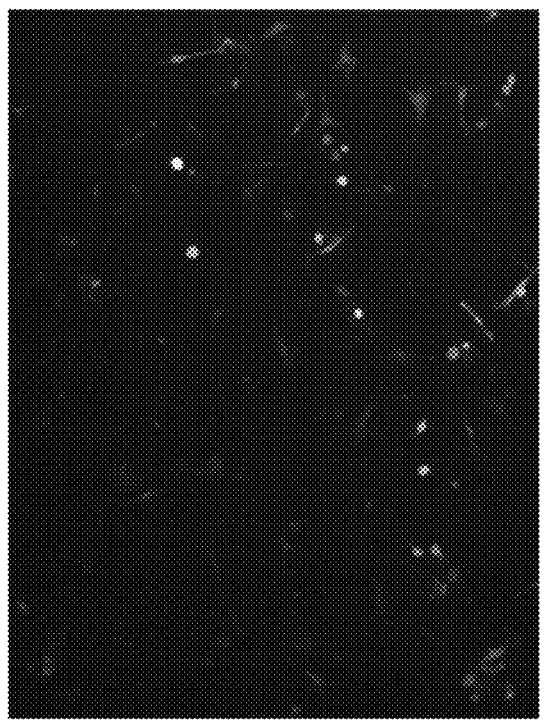
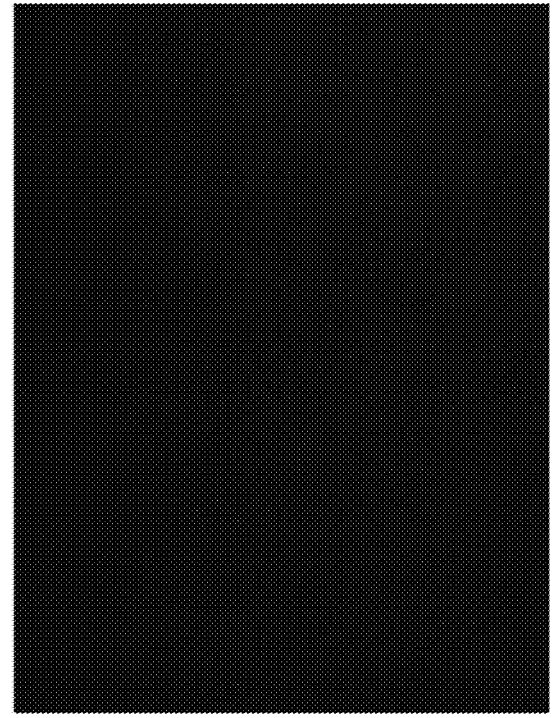

A

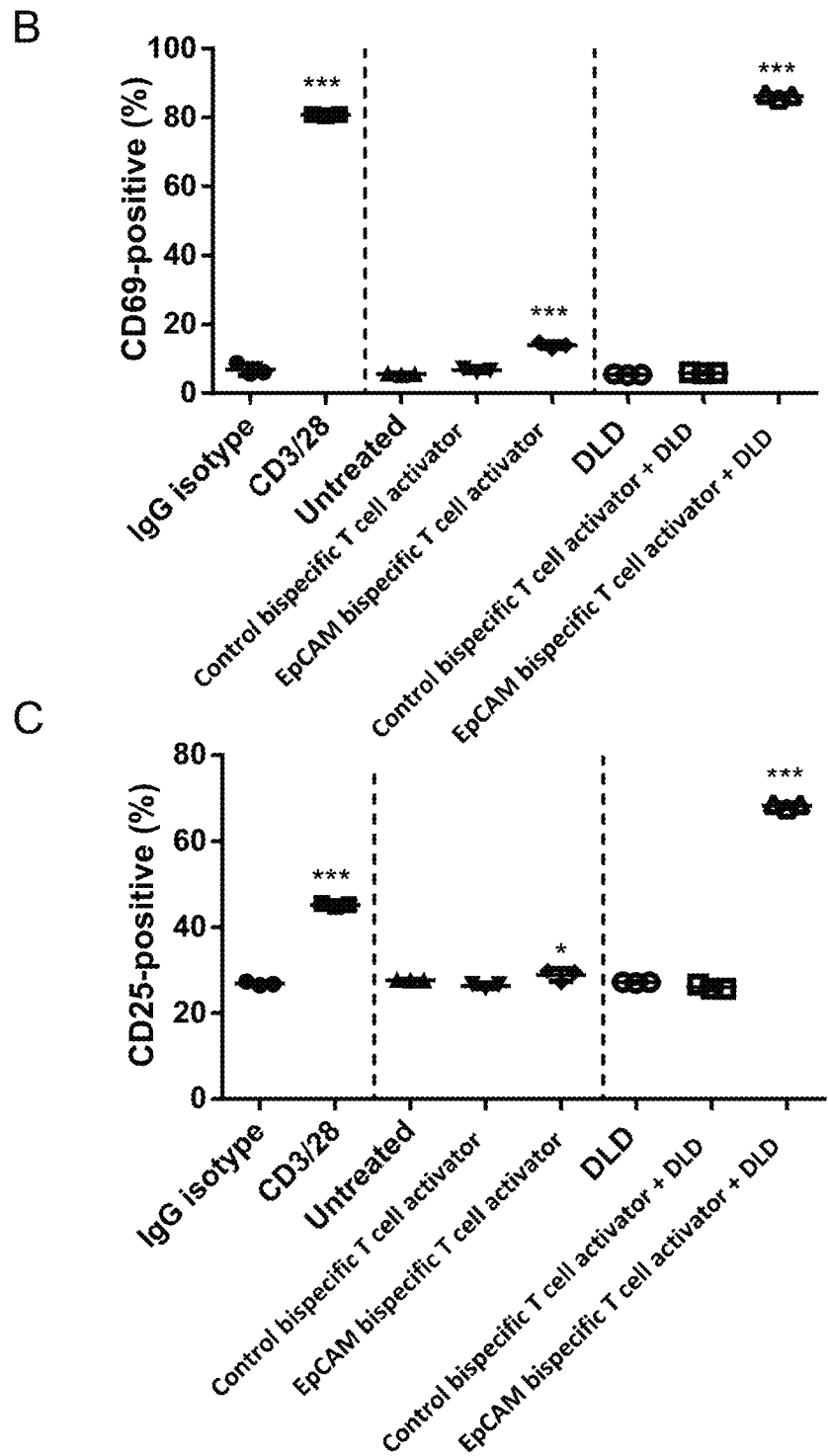
Figure 45, cont.

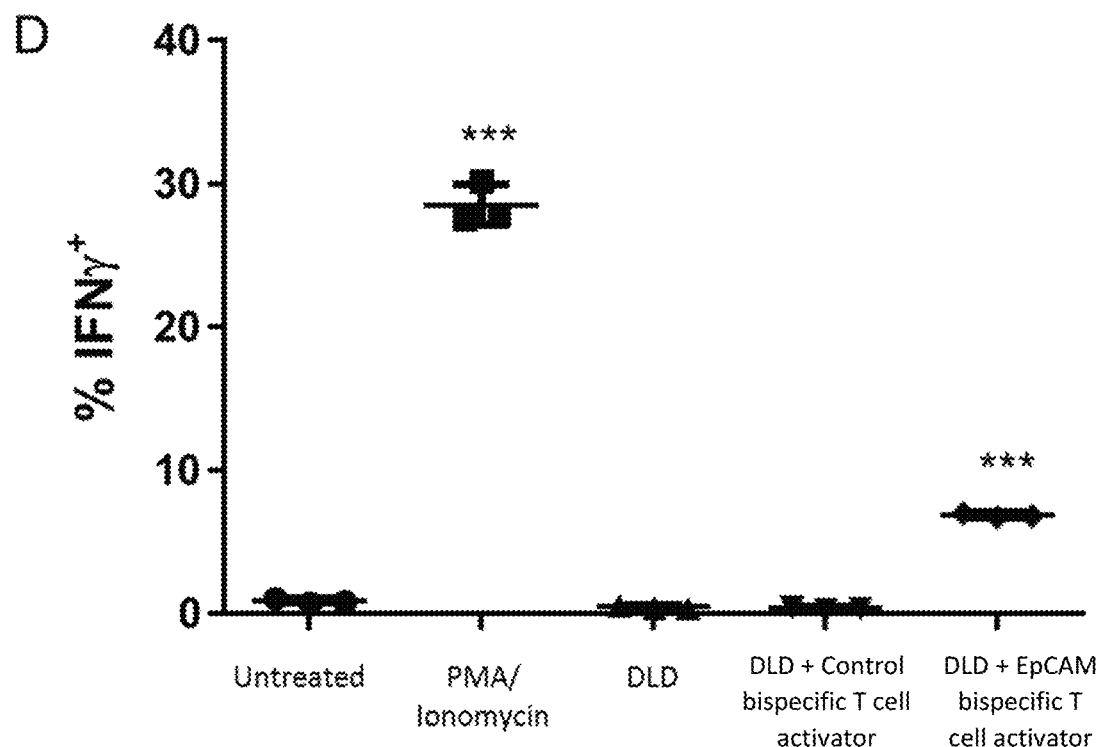
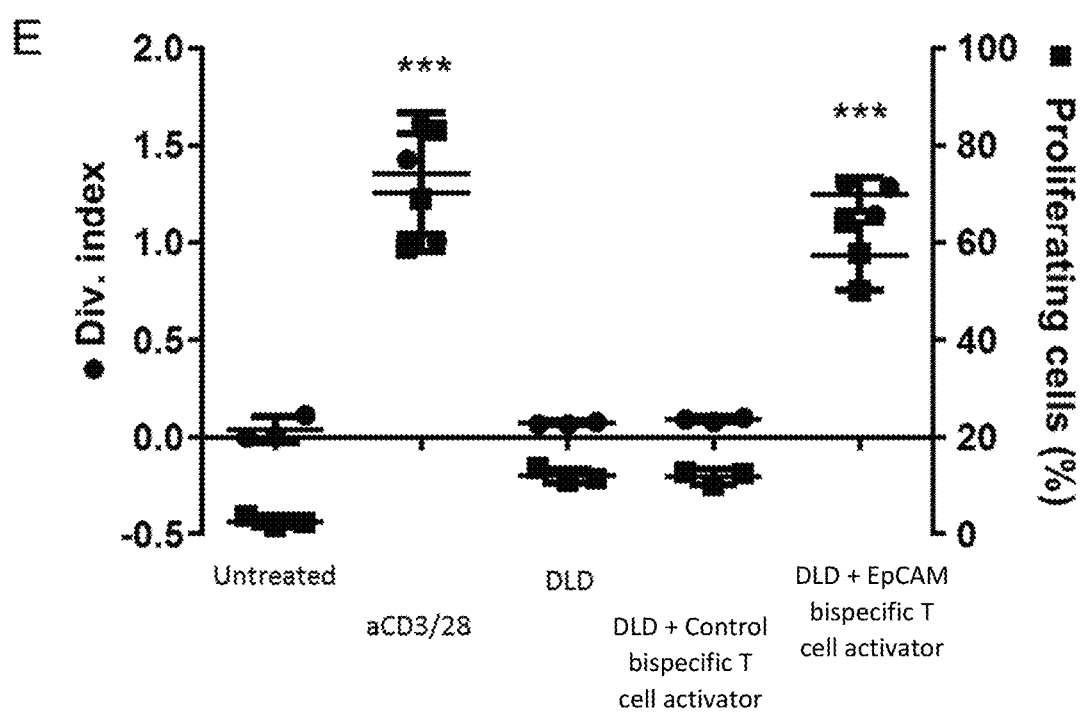
Figure 45, cont.

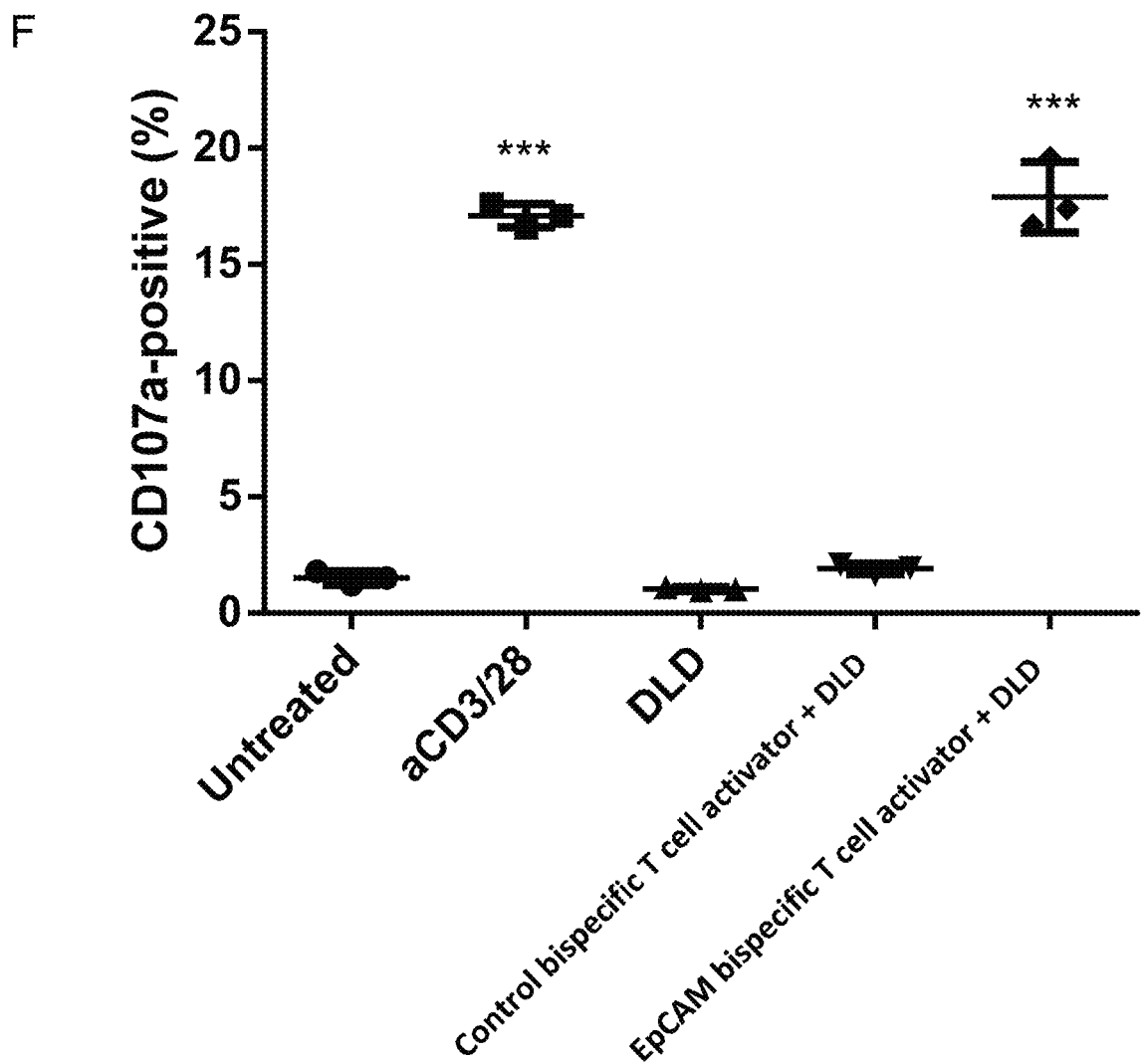
Figure 45, cont.

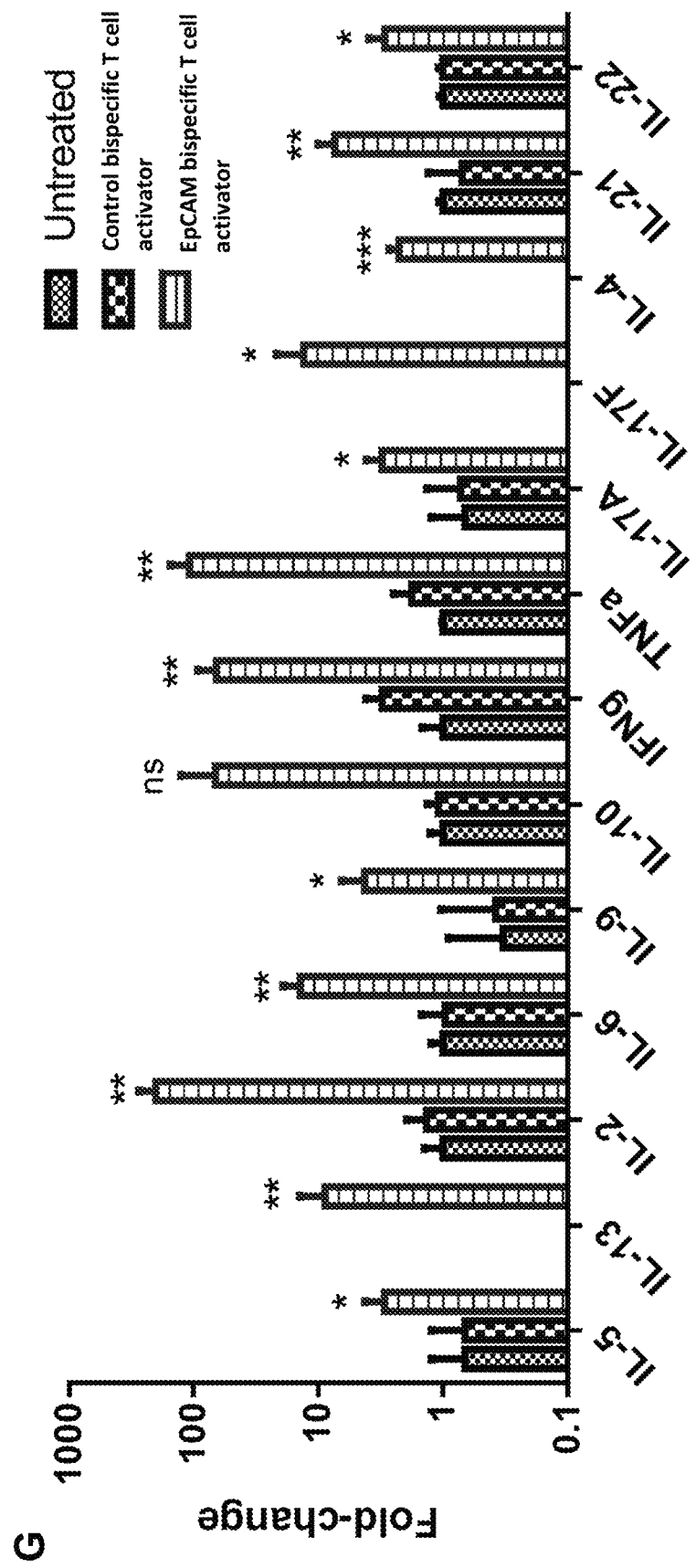
Figure 45, cont.

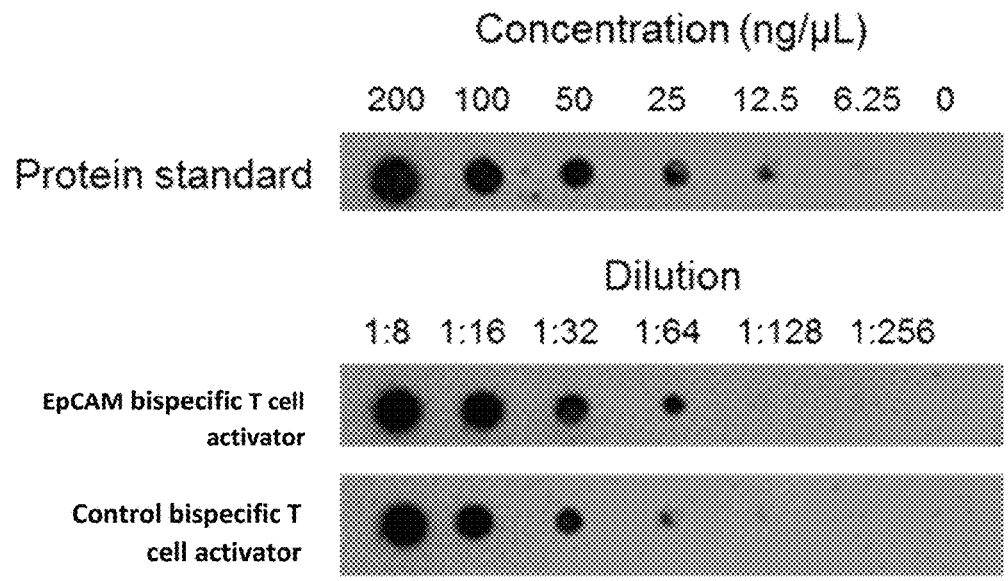
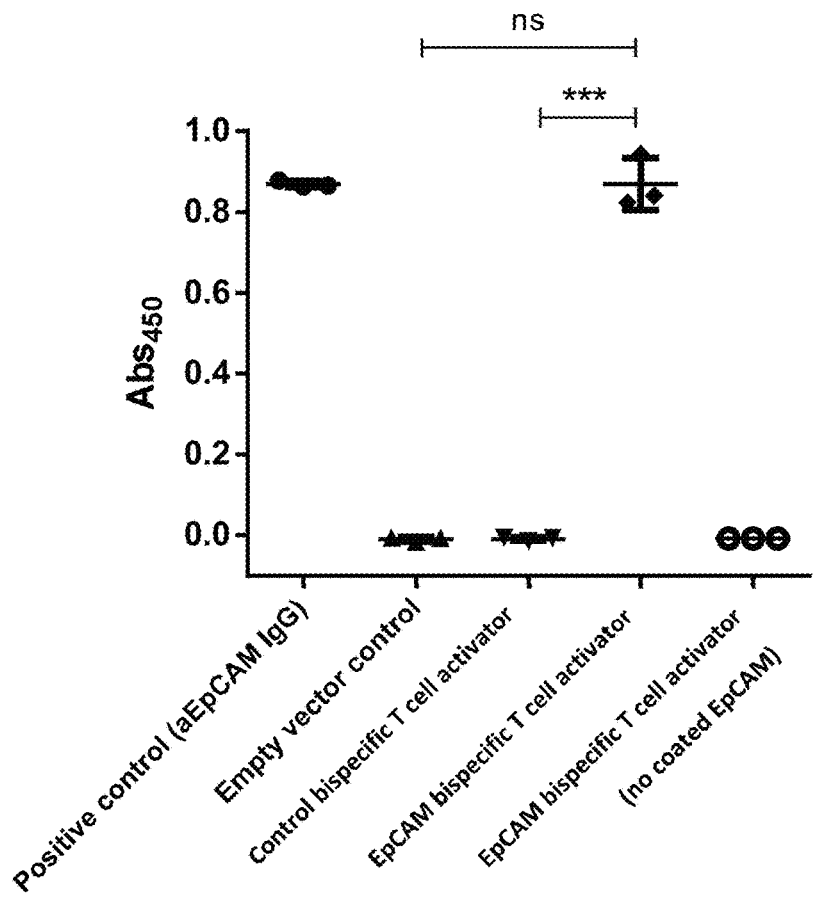
Figure 46

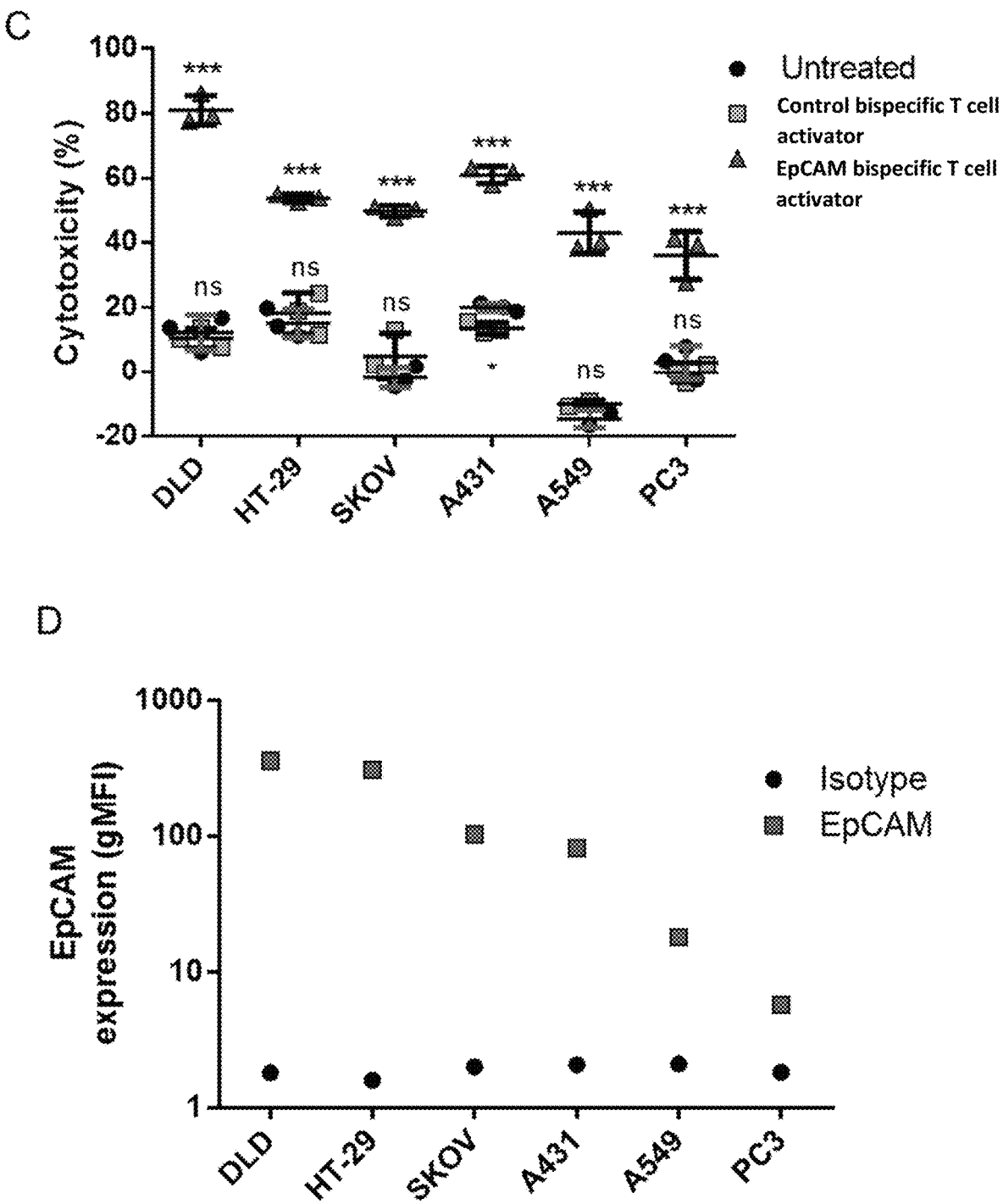
Figure 47, cont.

Figure 48
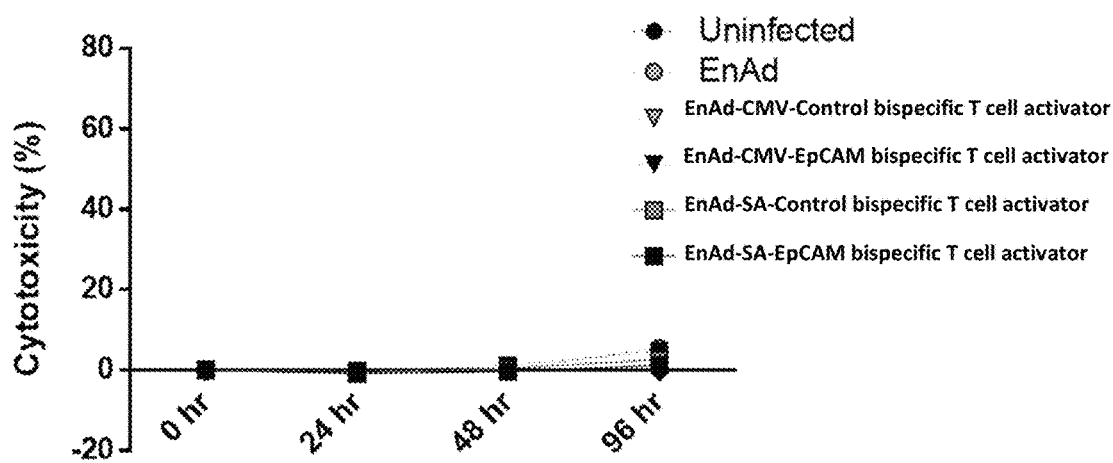
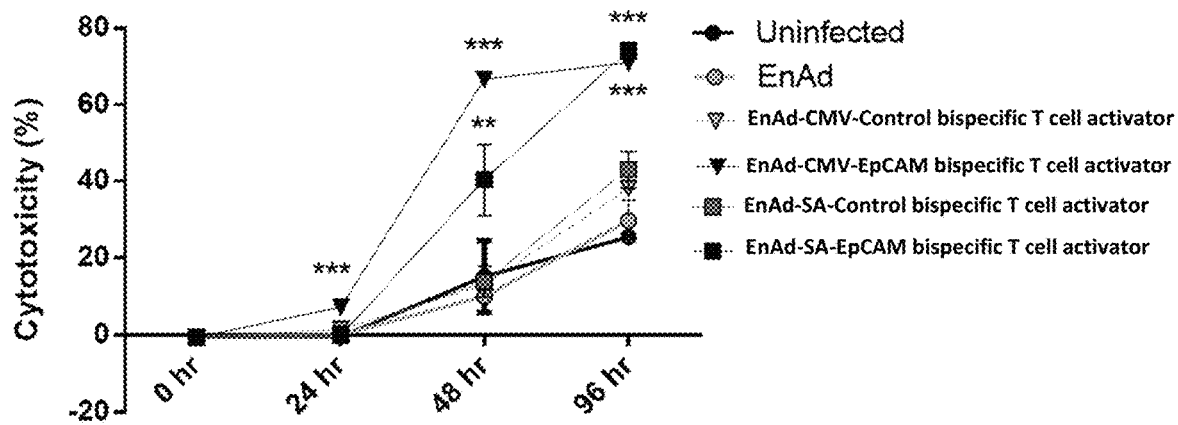

Figure 49
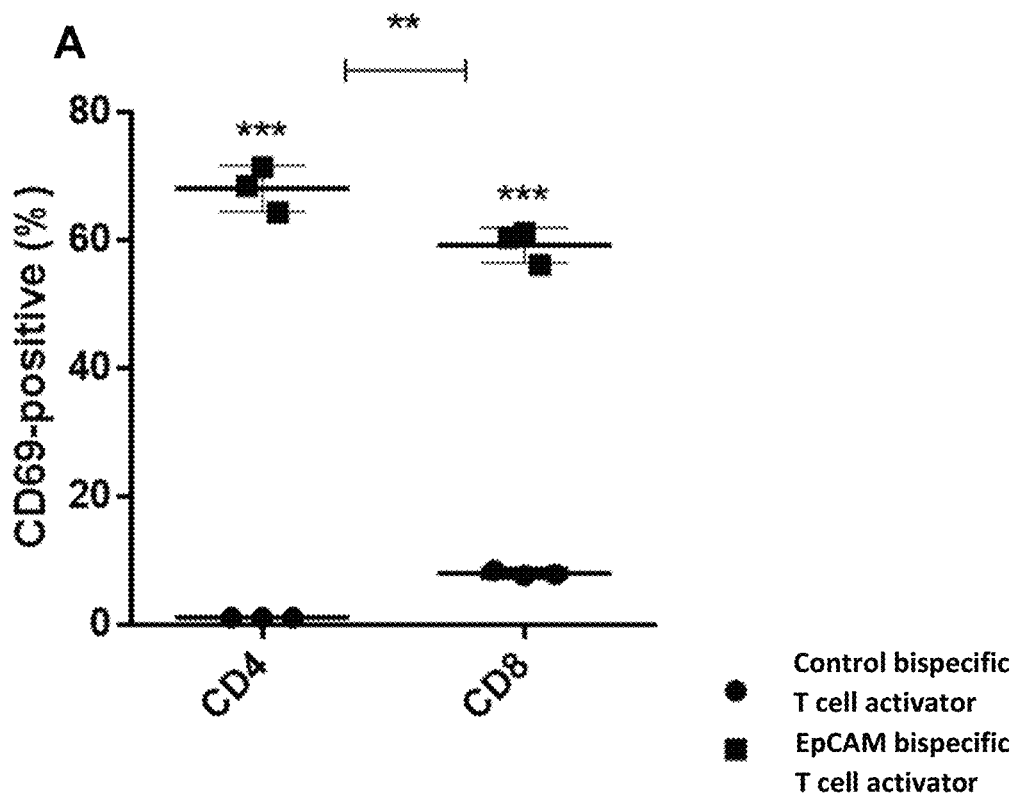
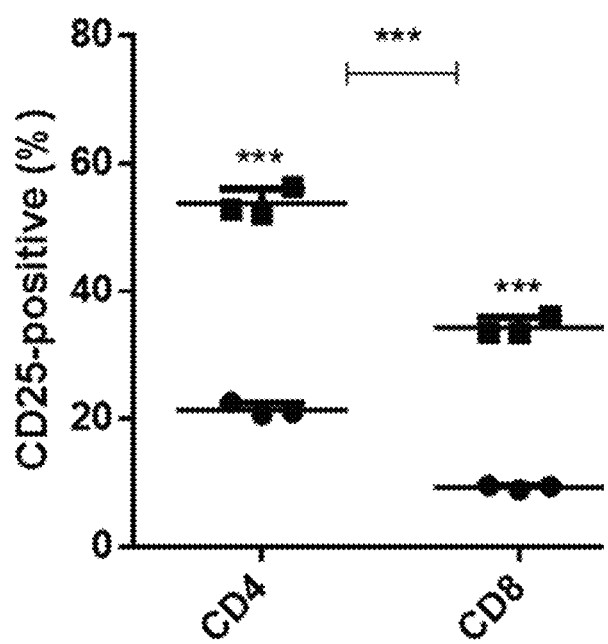

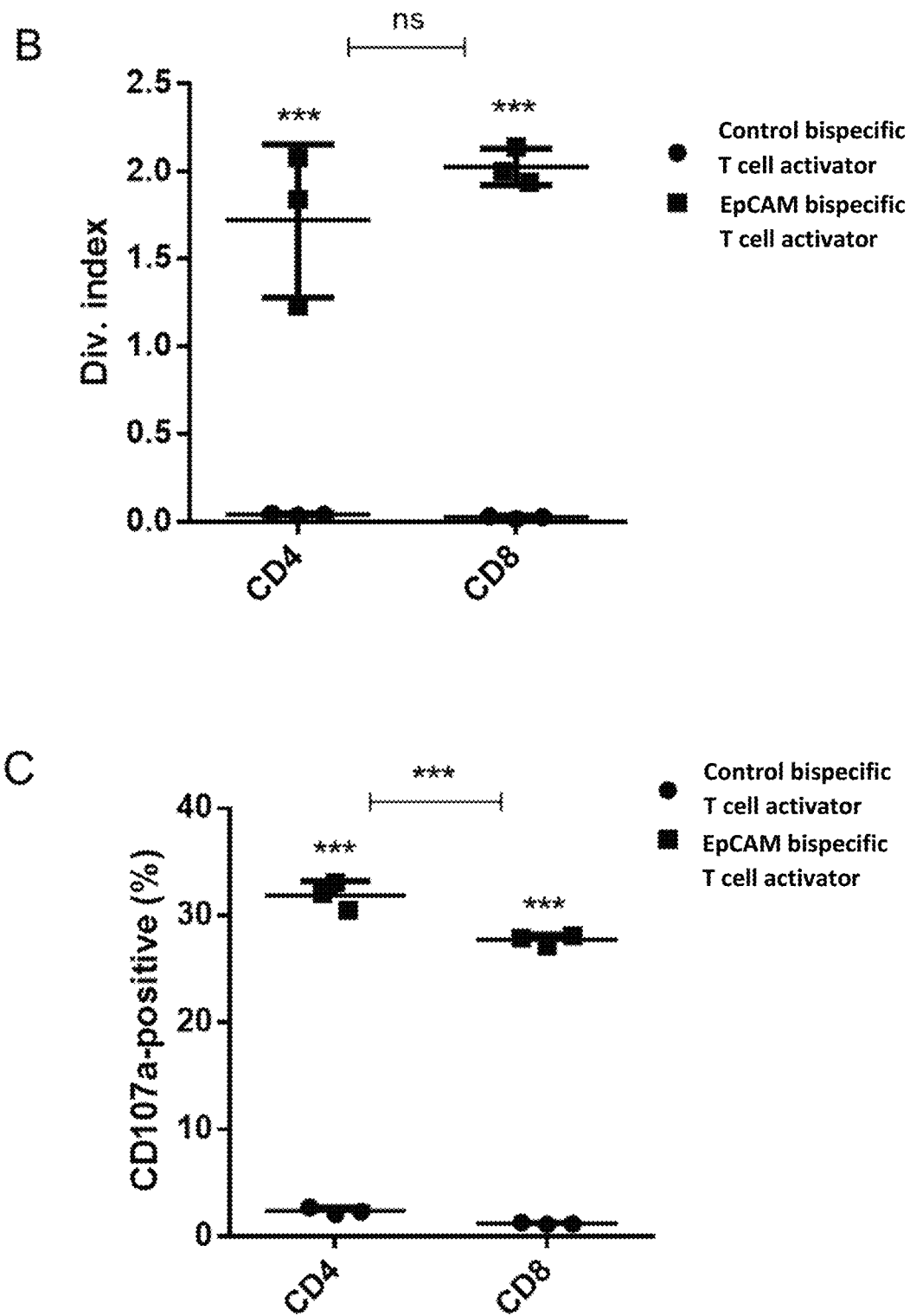
Figure 49, cont.

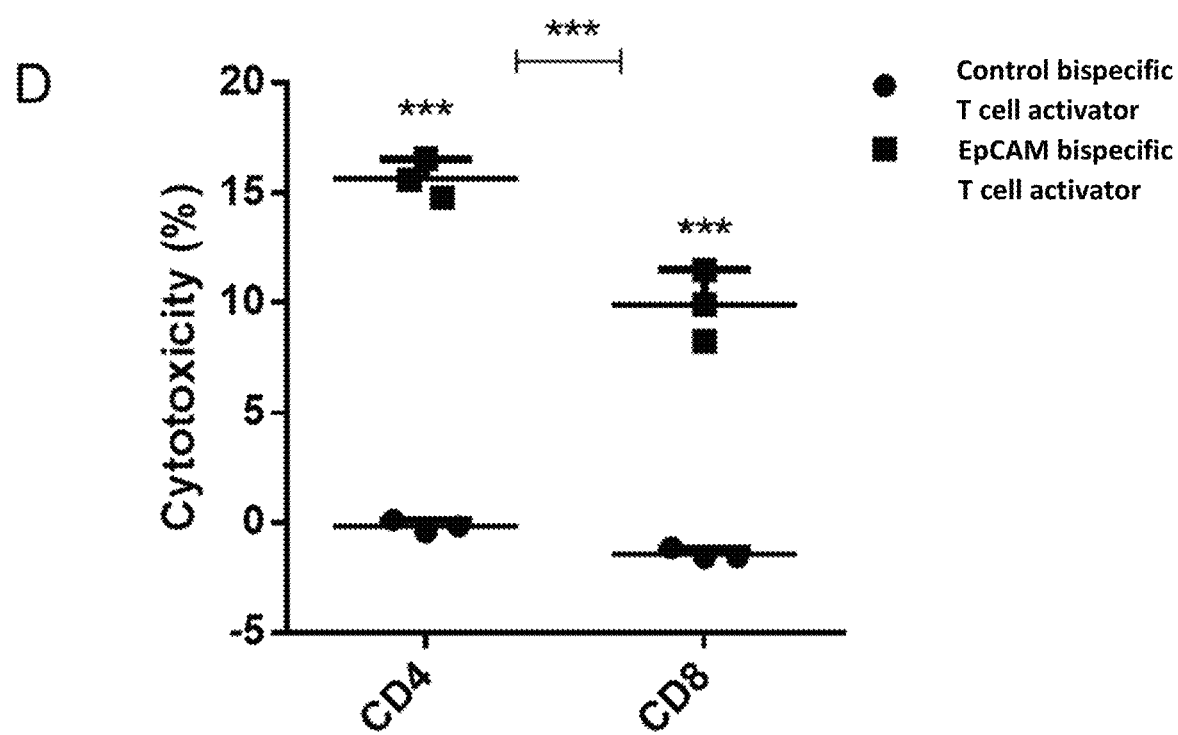
Figure 49, cont.

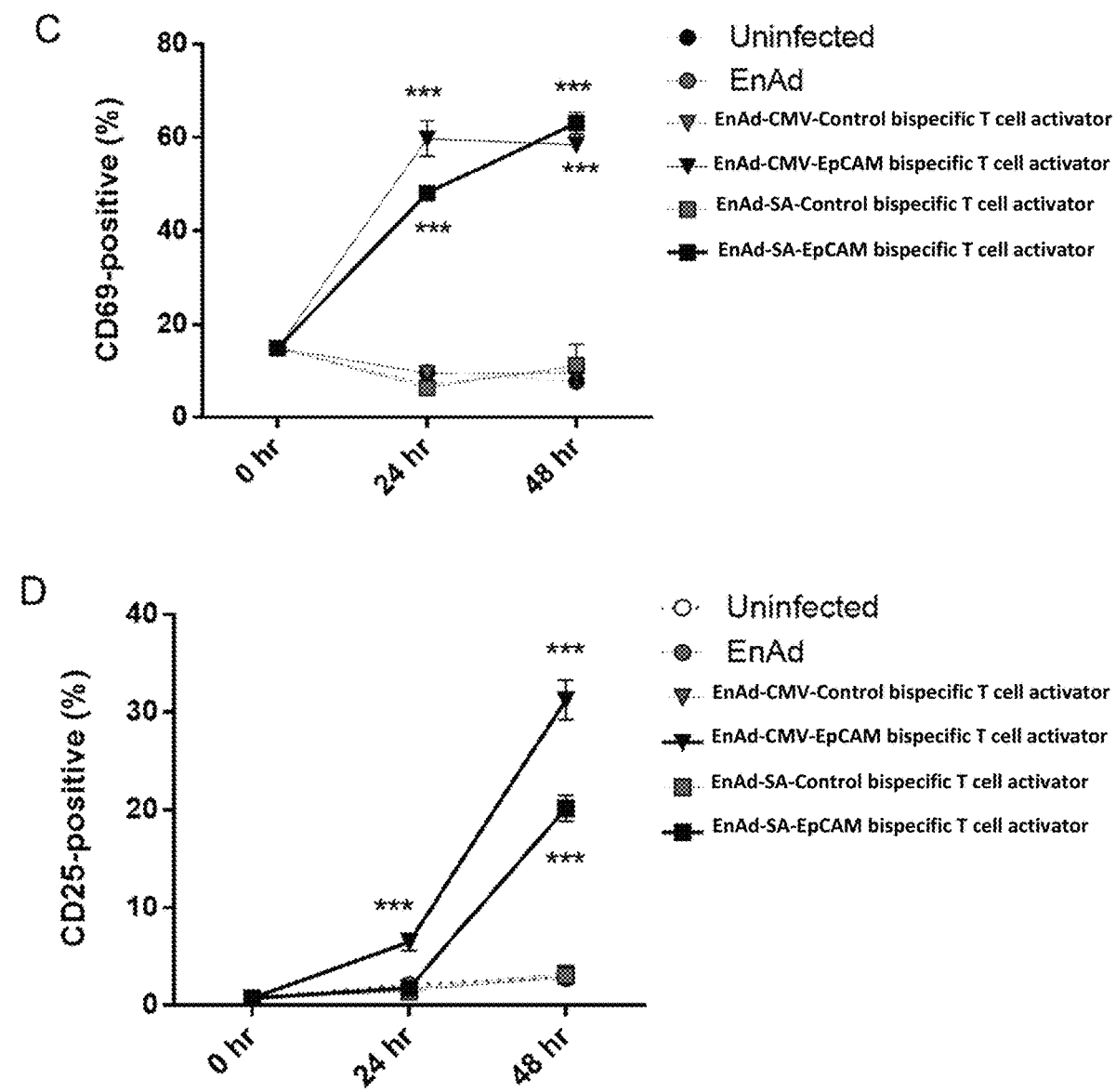
Figure 50, cont.

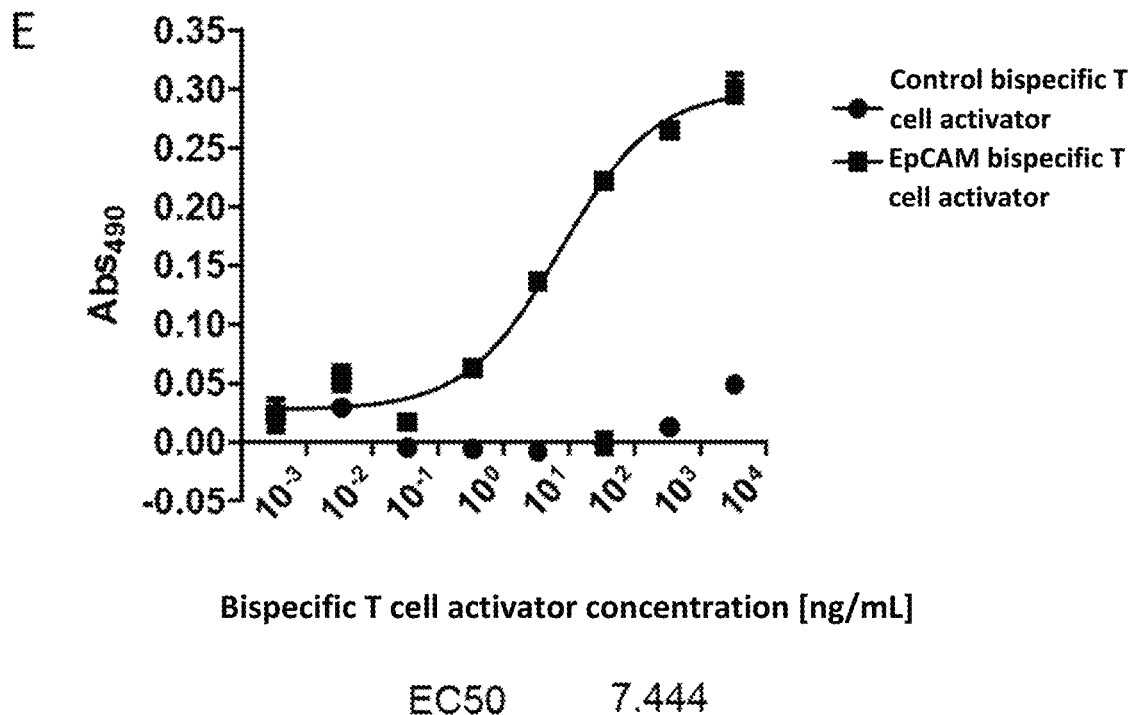
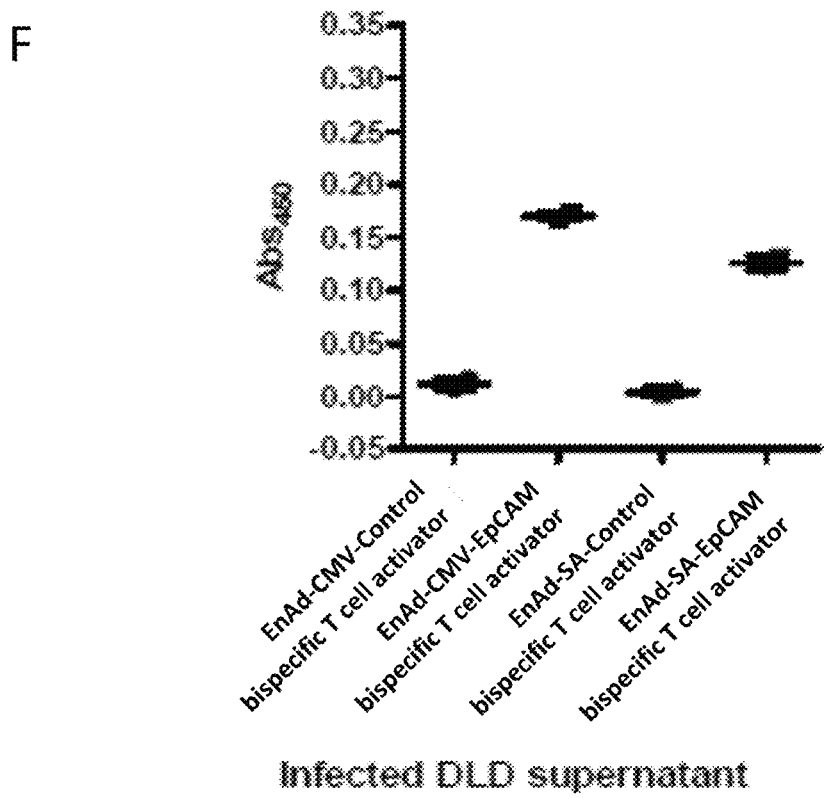
Figure 50, cont.

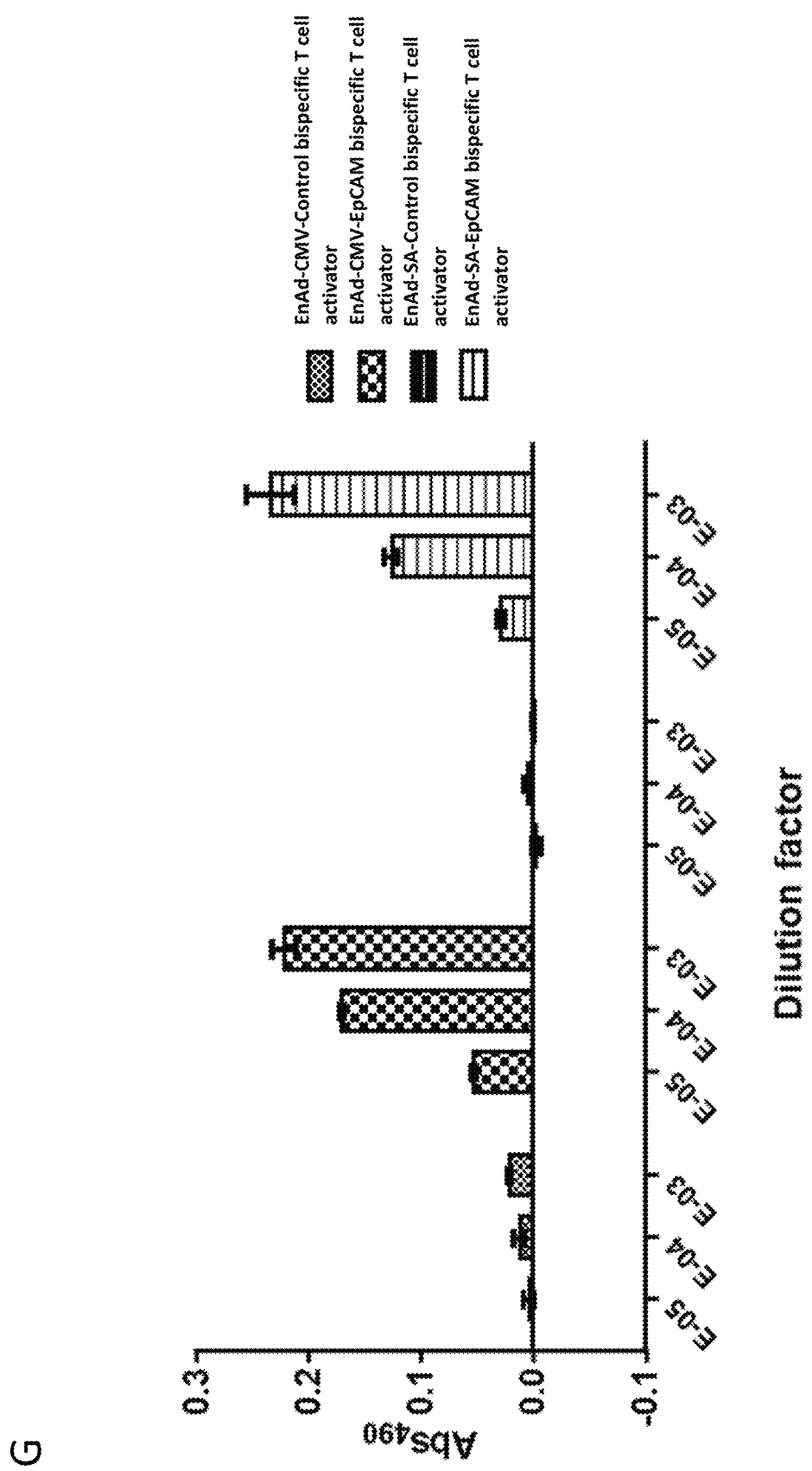
Figure 50, cont.

A
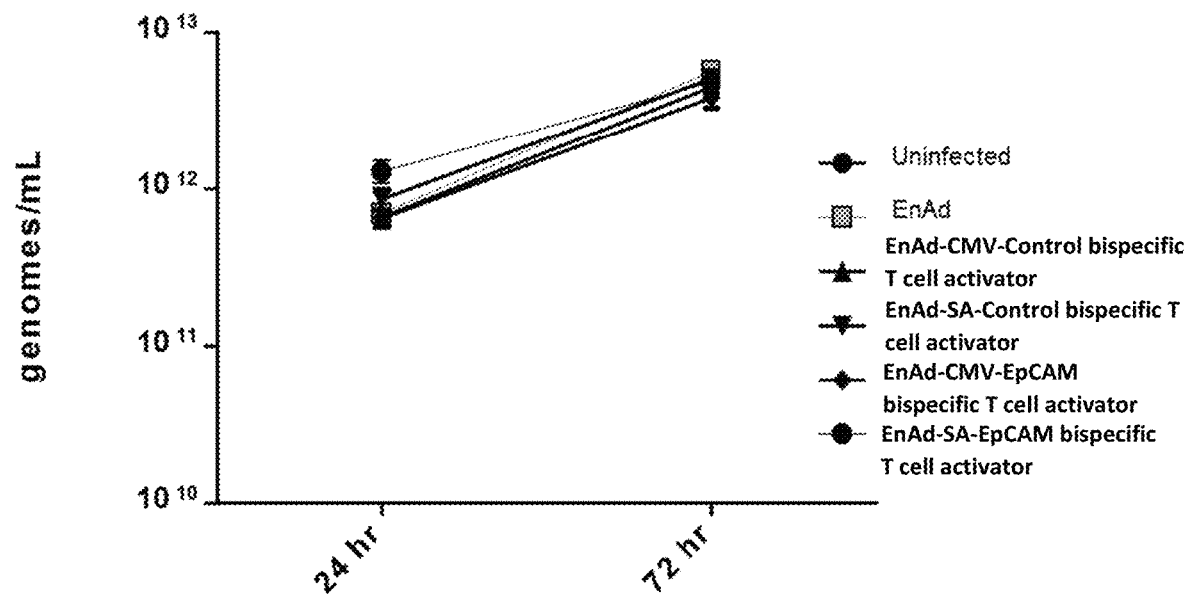
B
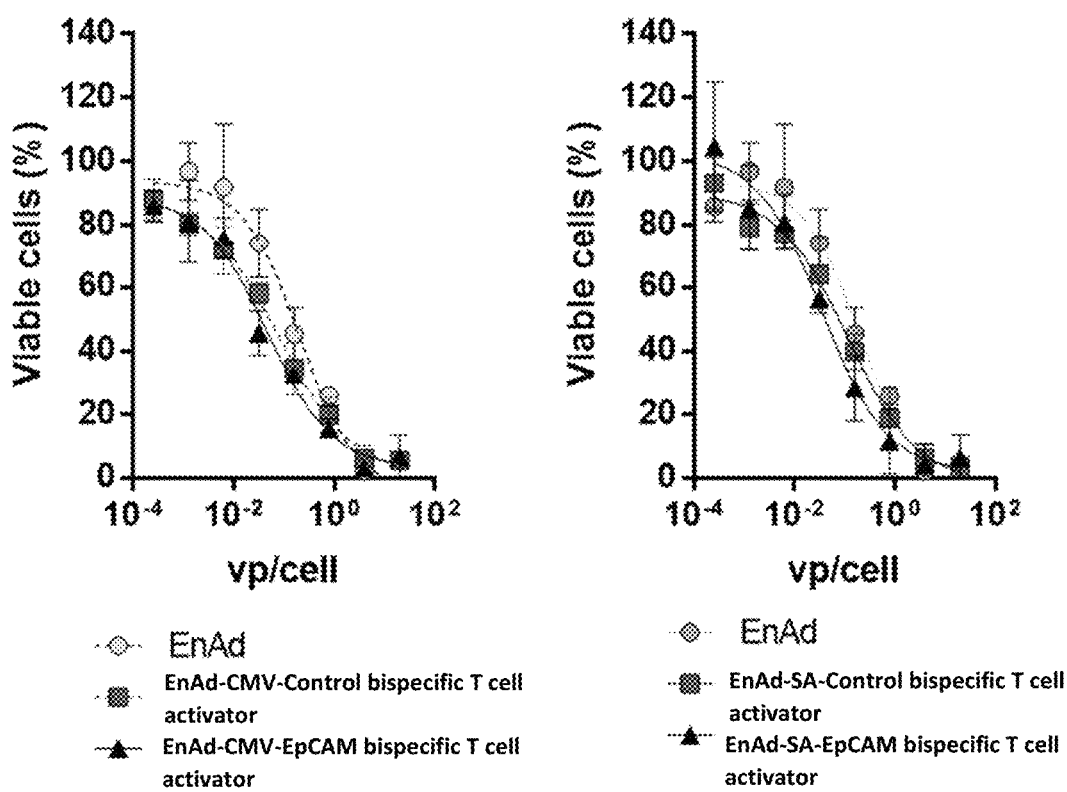
Figure 51

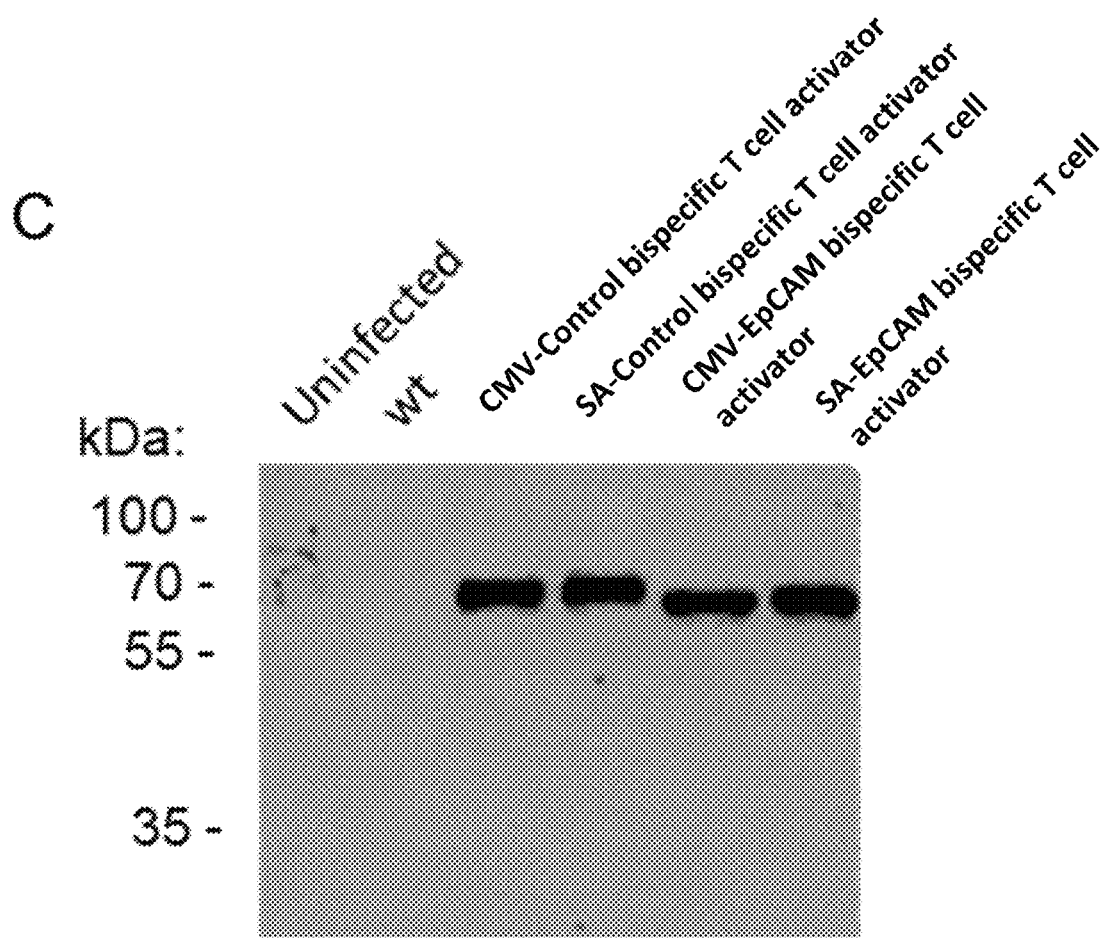
Figure 51, cont.

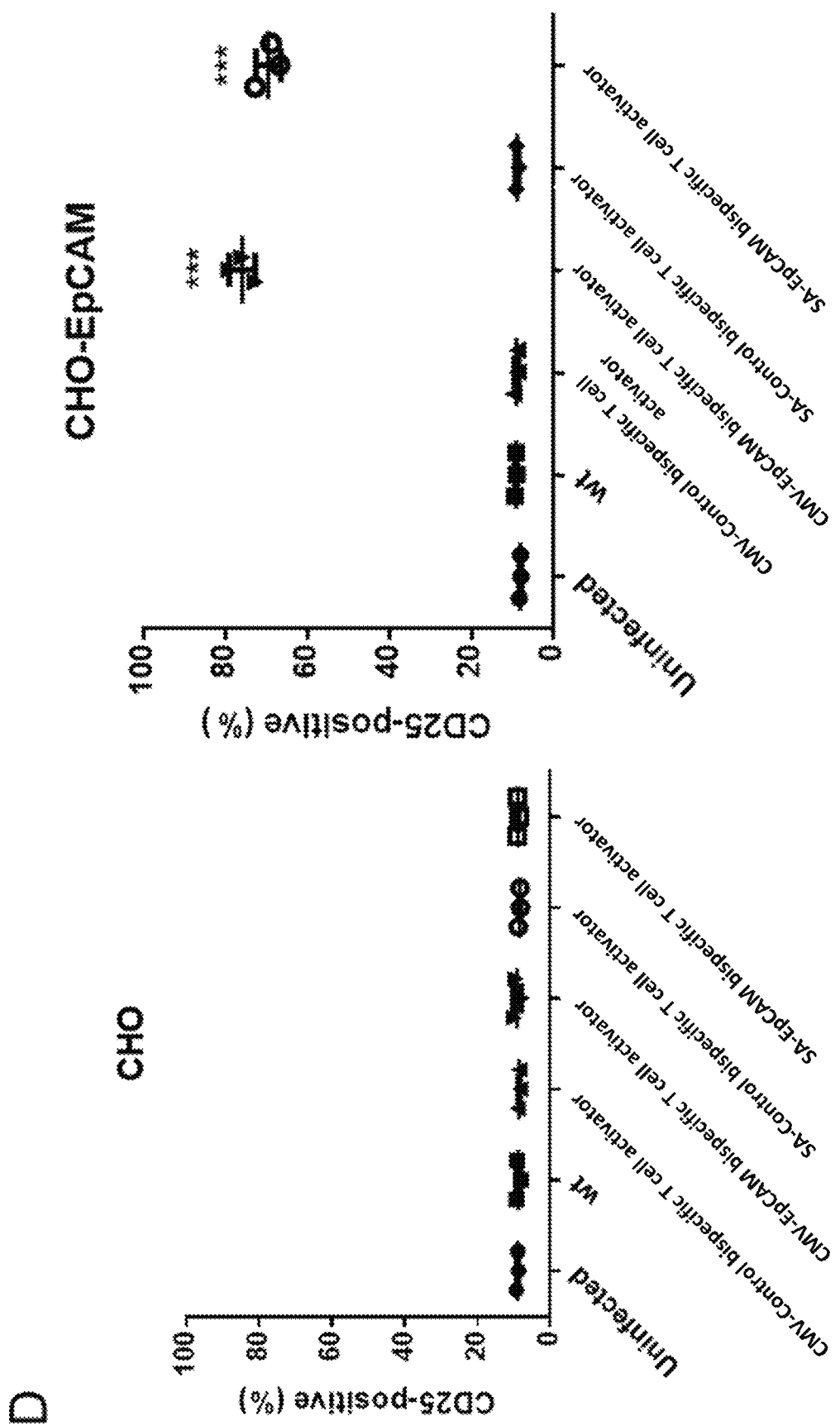
Figure 51, cont.

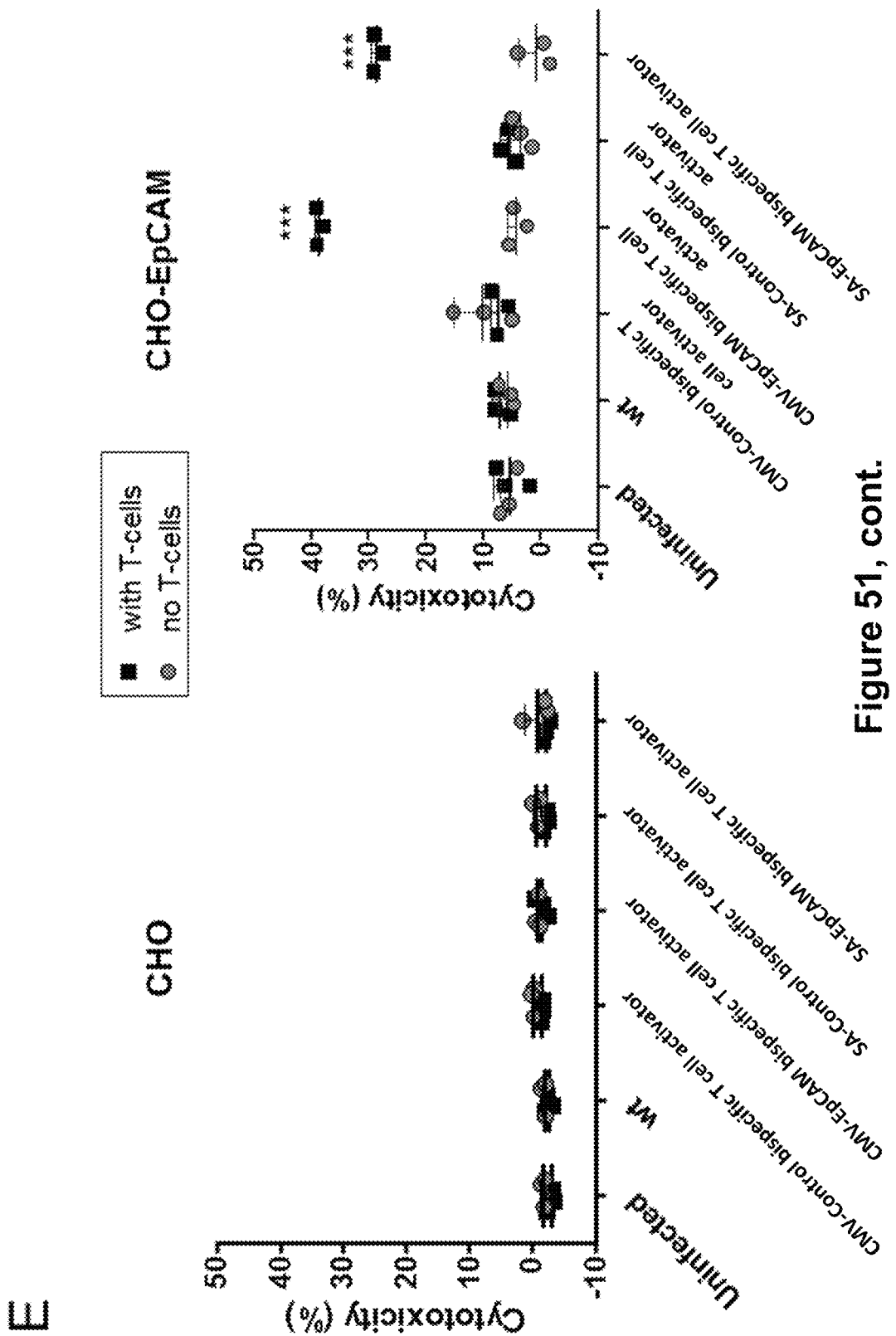
Figure 51, cont.

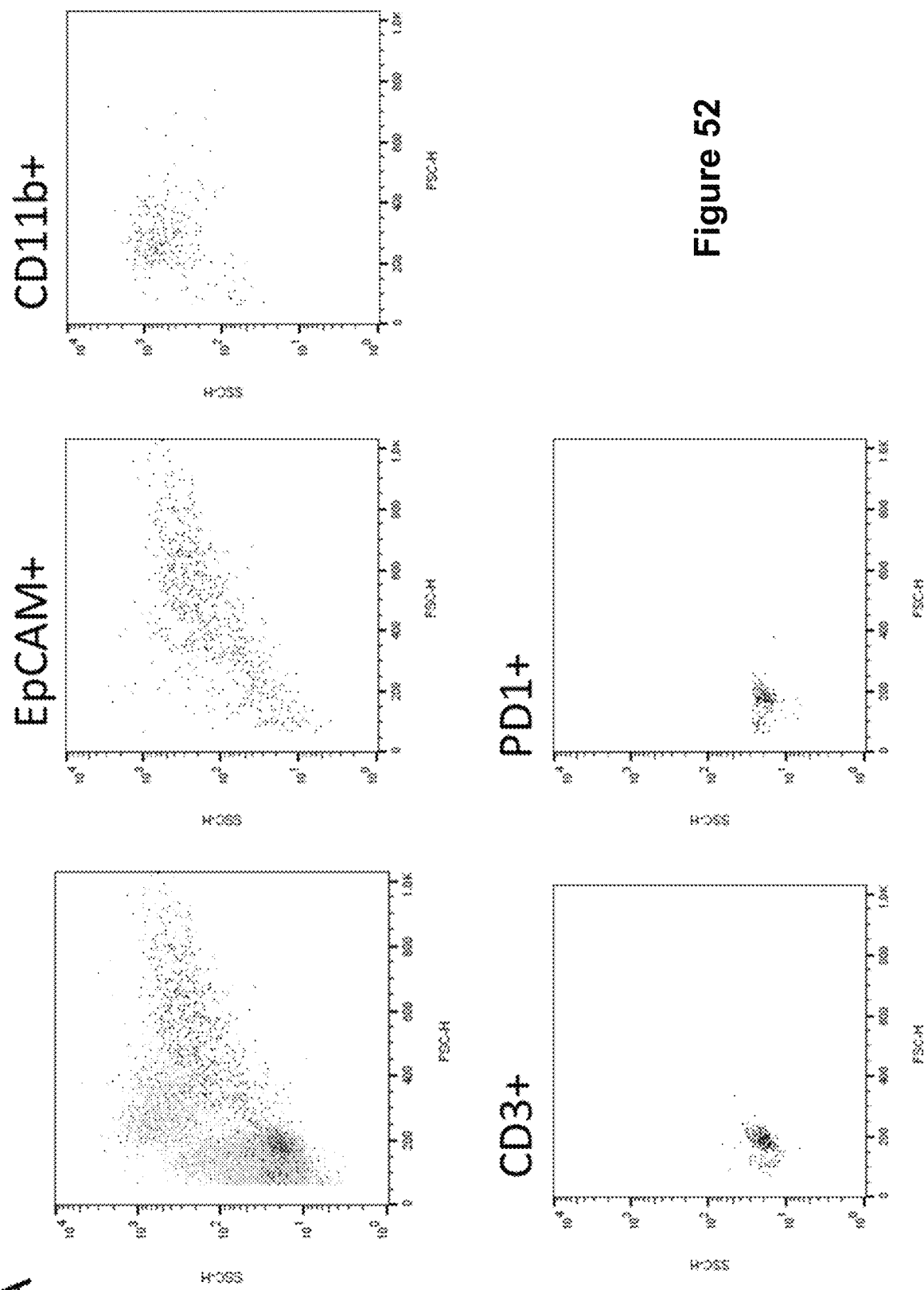

B

| Subset | Count |
|--------|-------|
| EpCAM  | 749   |
| CD3    | 289   |
| PD1    | 206   |
| CD11b  | 277   |
| Total  | 10000 |

Figure 52, cont.

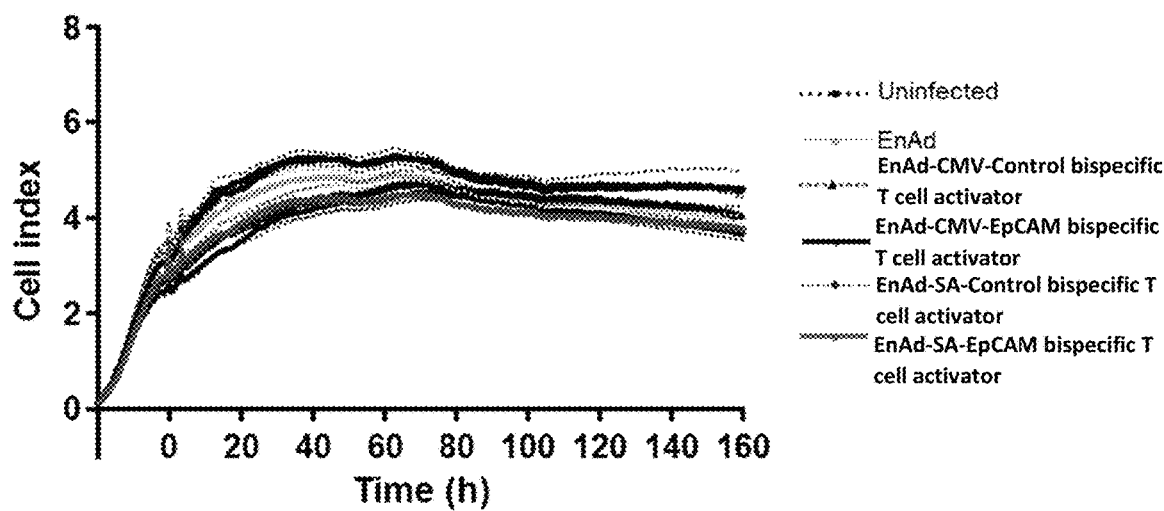
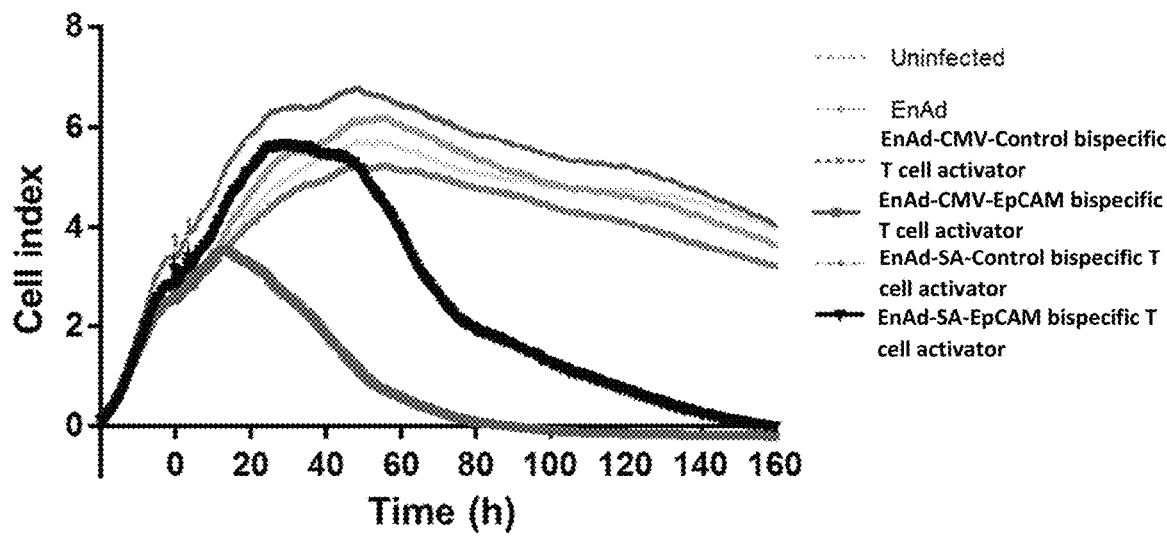
Figure 53

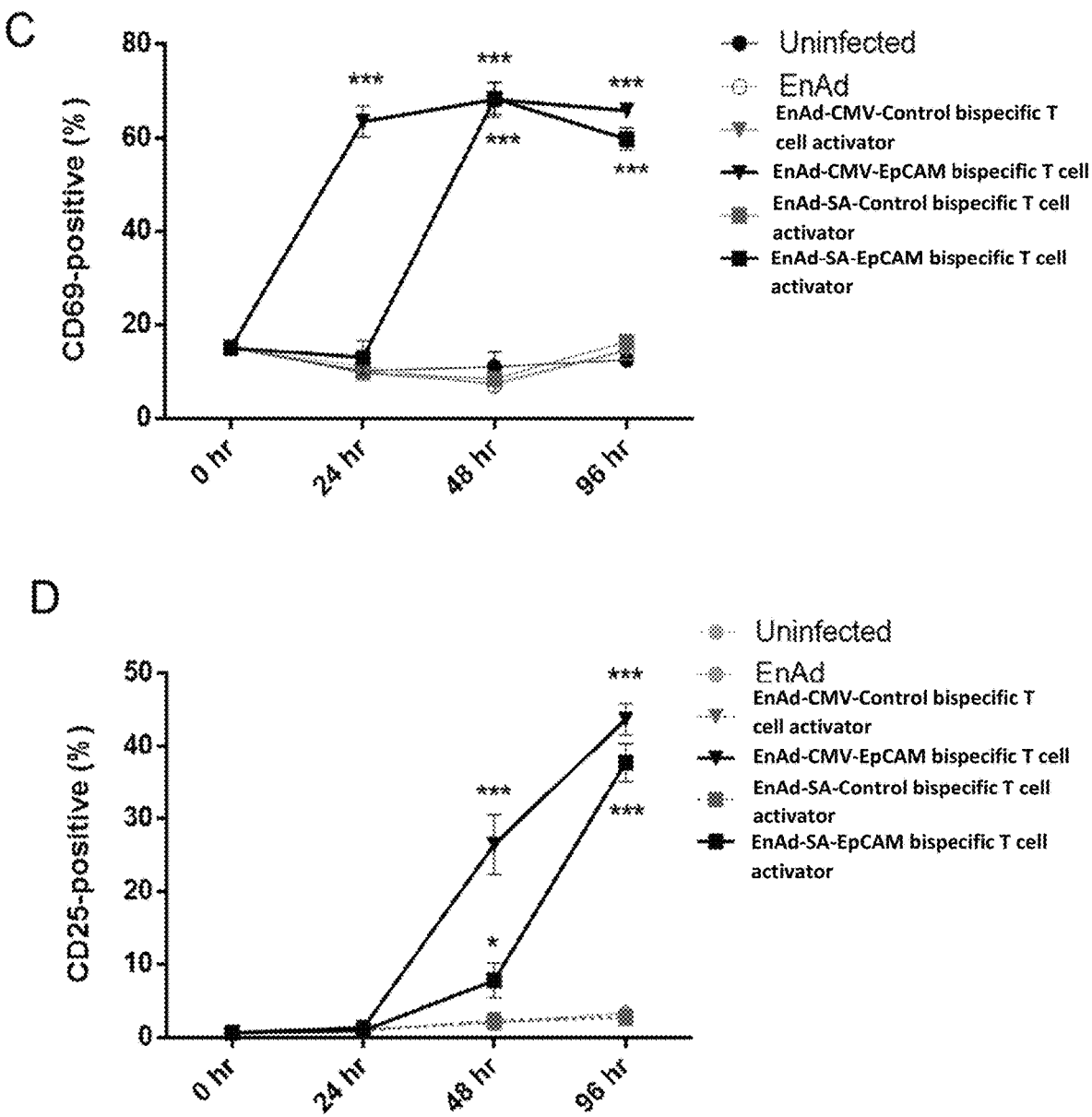
Figure 53, cont.

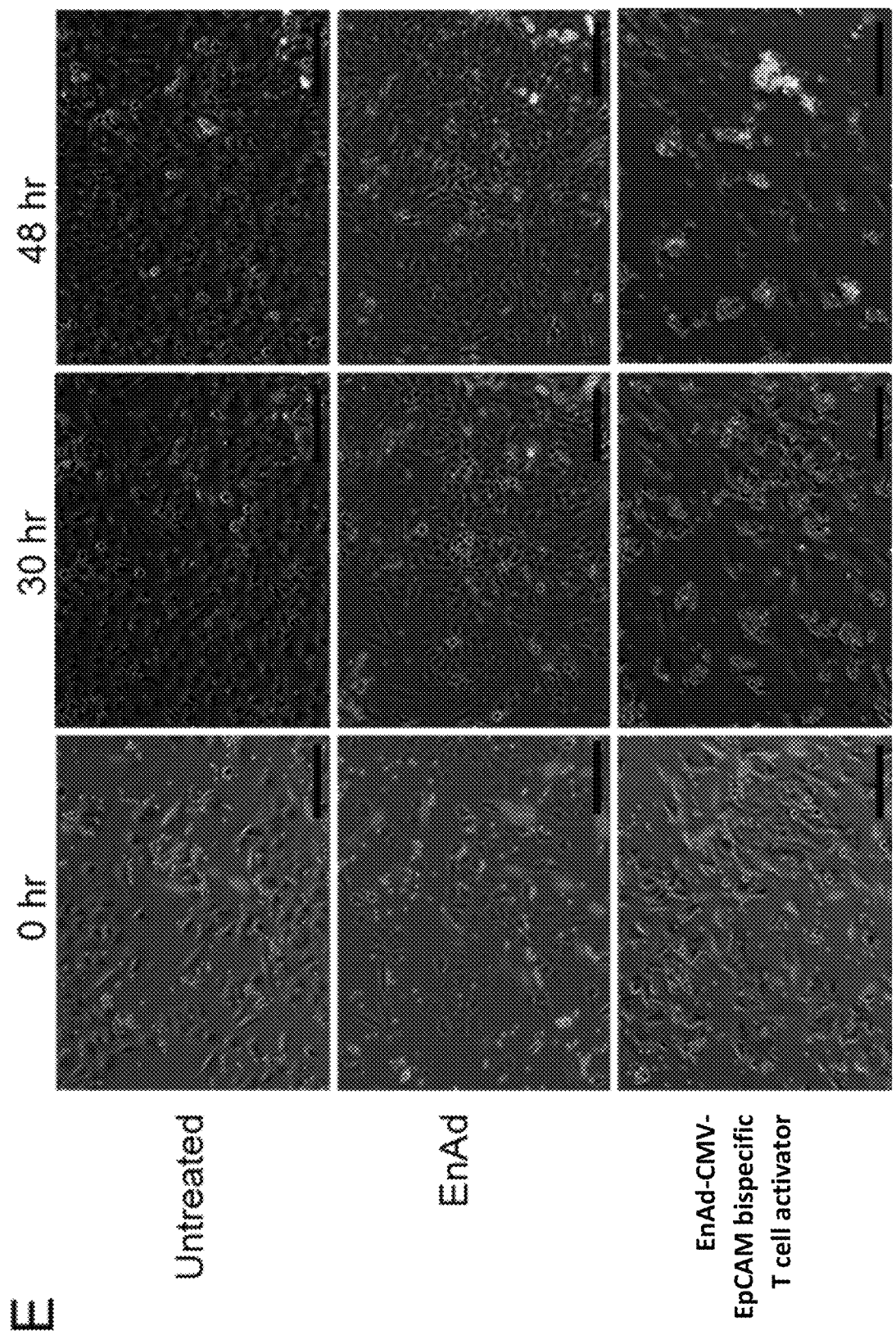
Figure 53, cont.

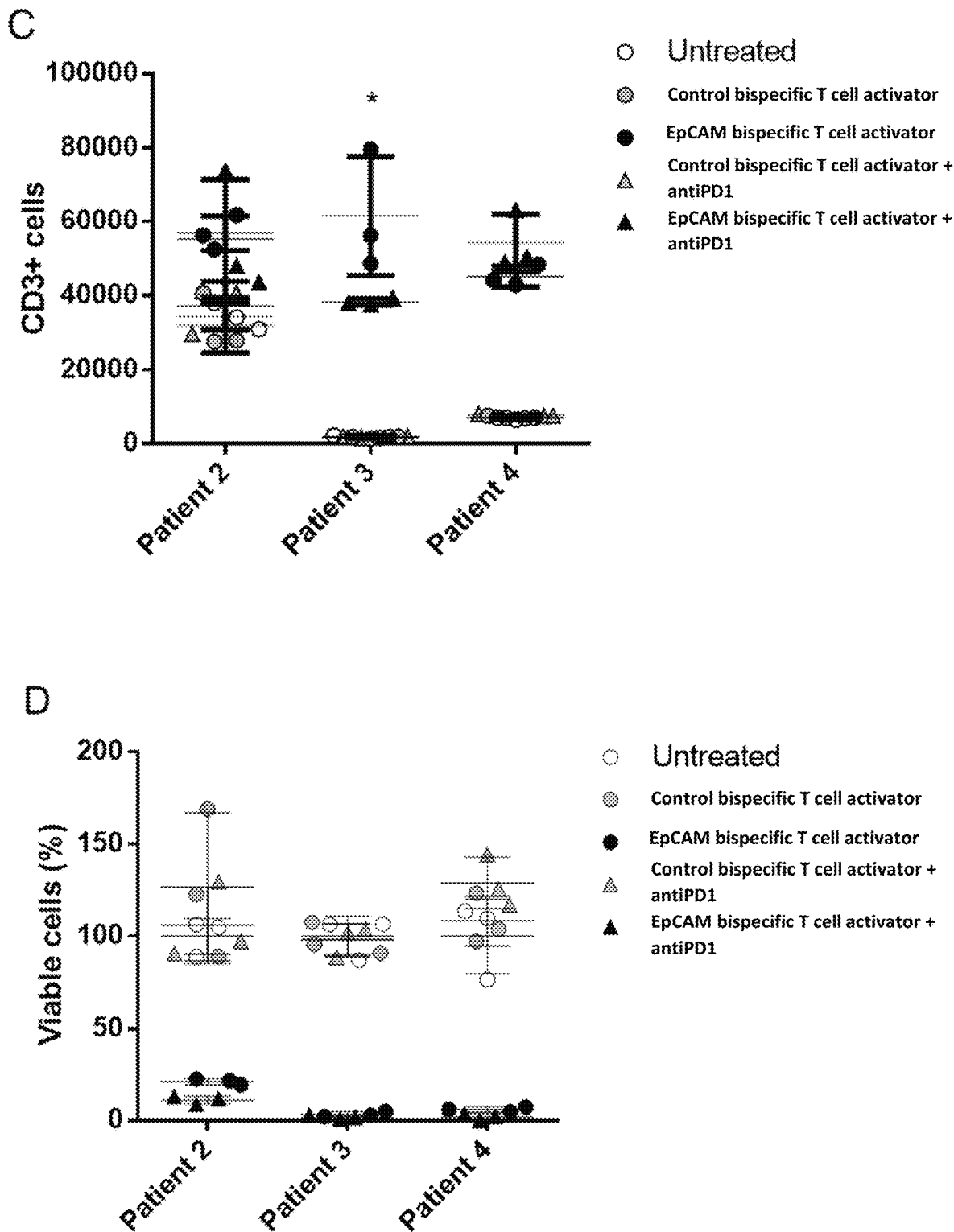
Figure 54, cont.

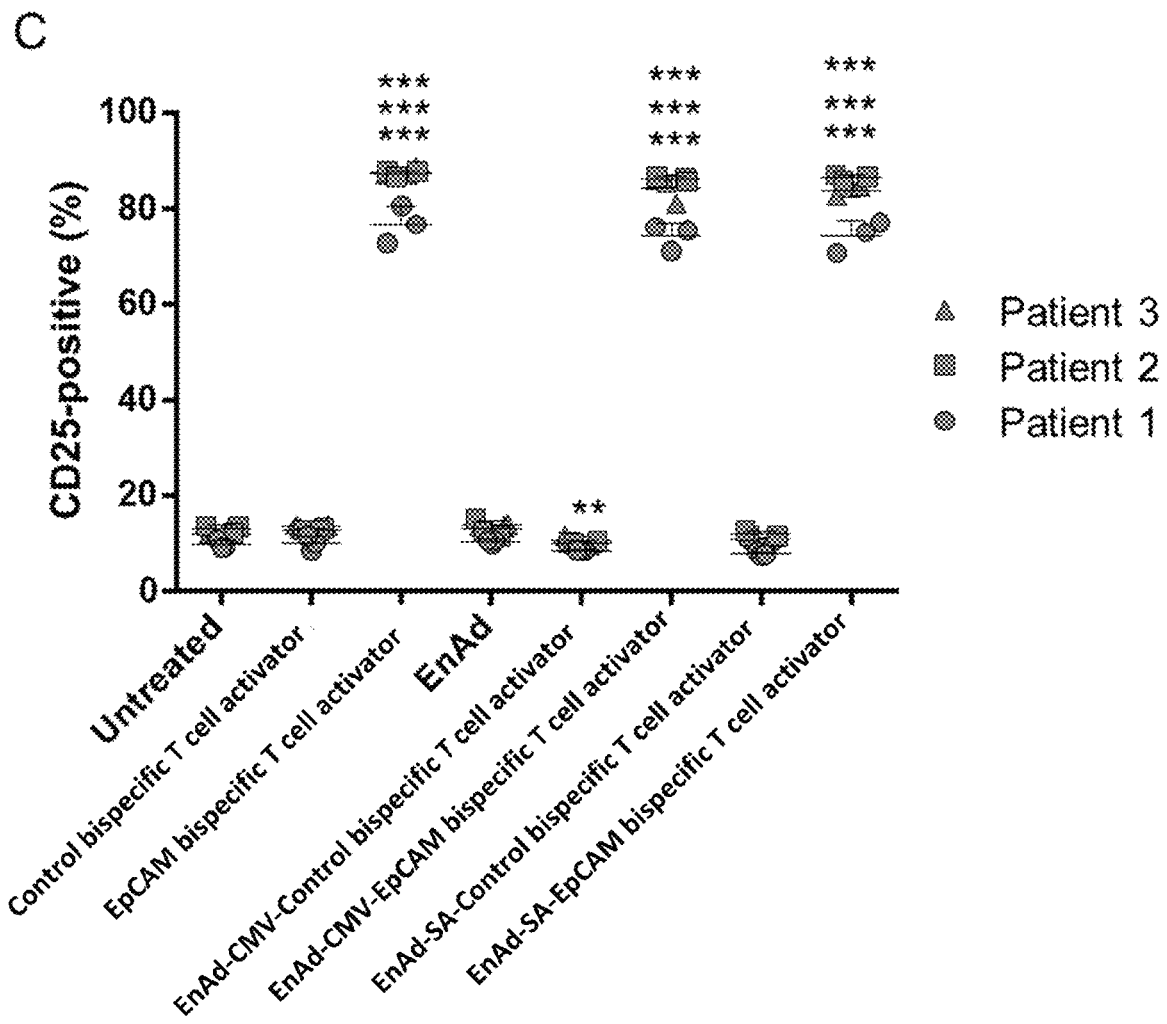
Figure 55, cont.

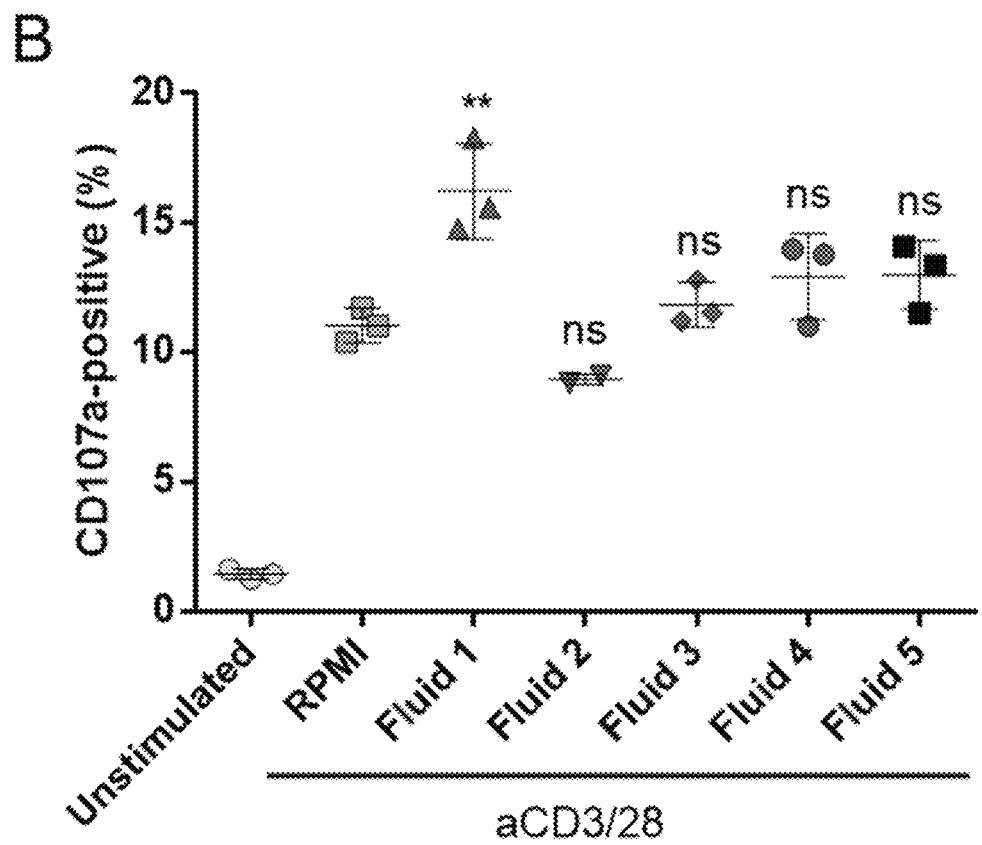
Figure 56, cont.

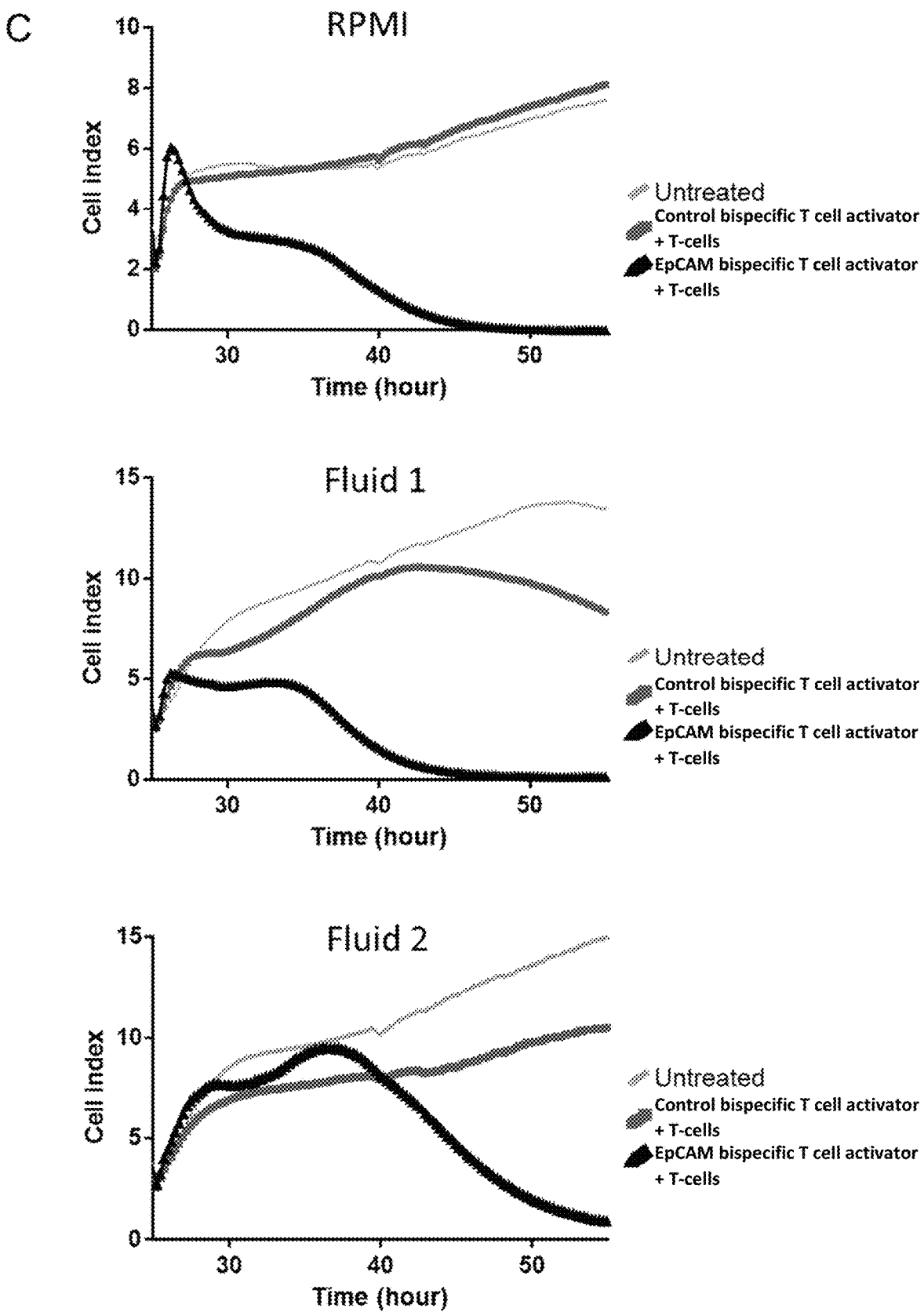
Figure 56, cont.

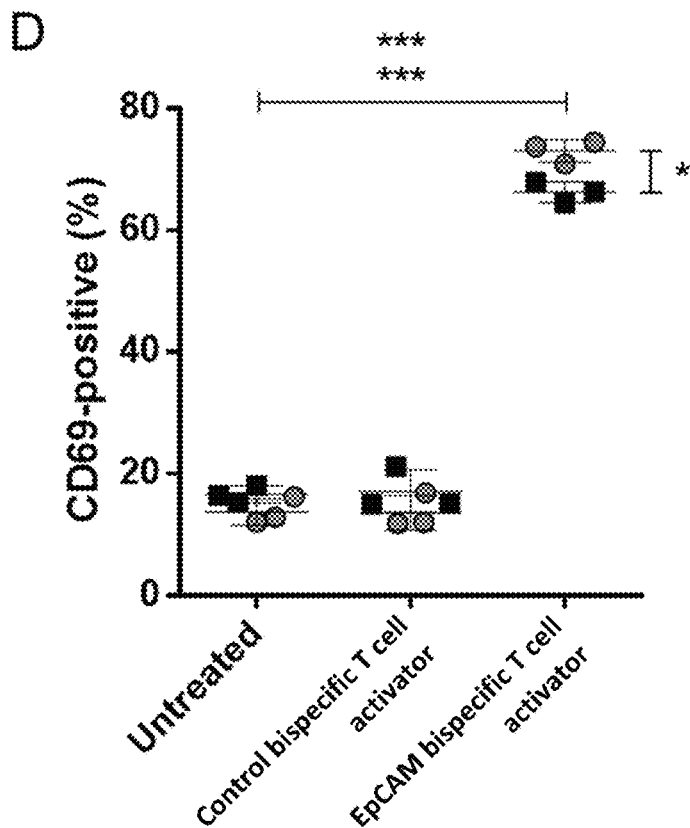
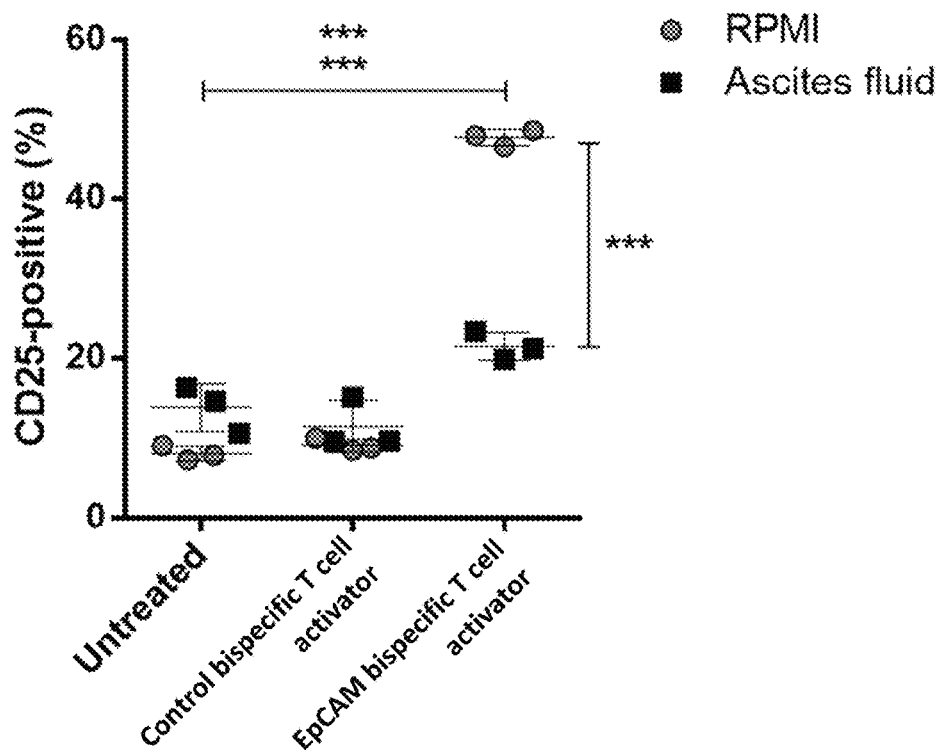
Figure 56, cont.

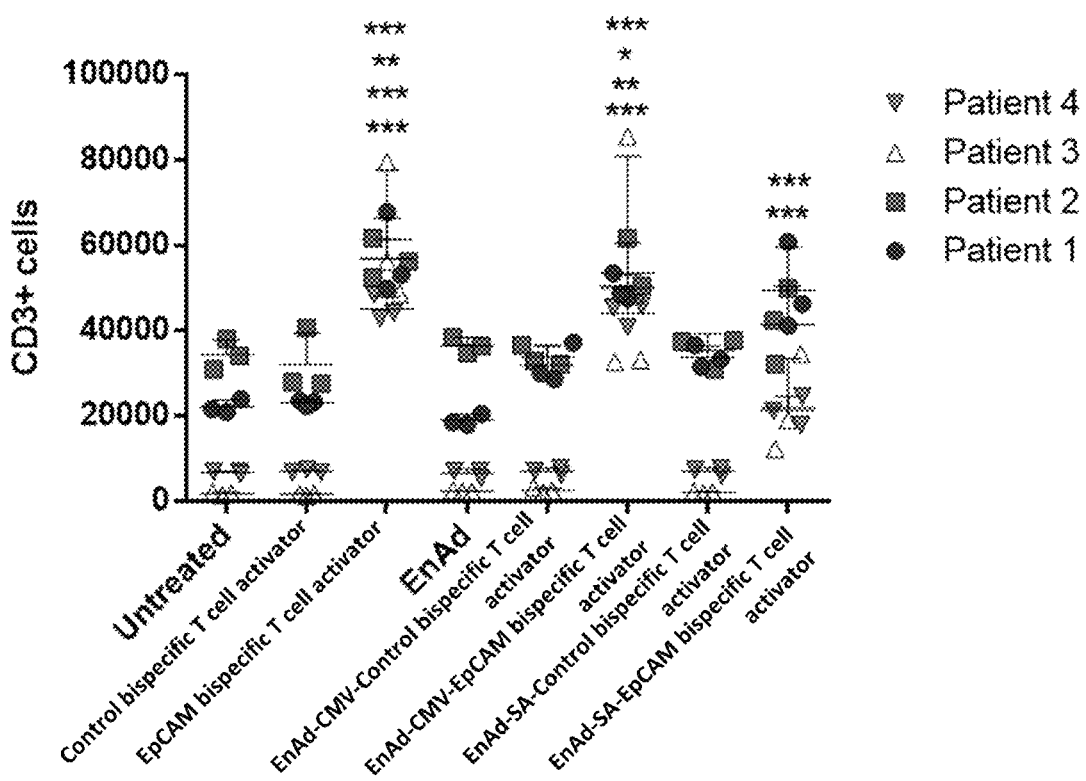
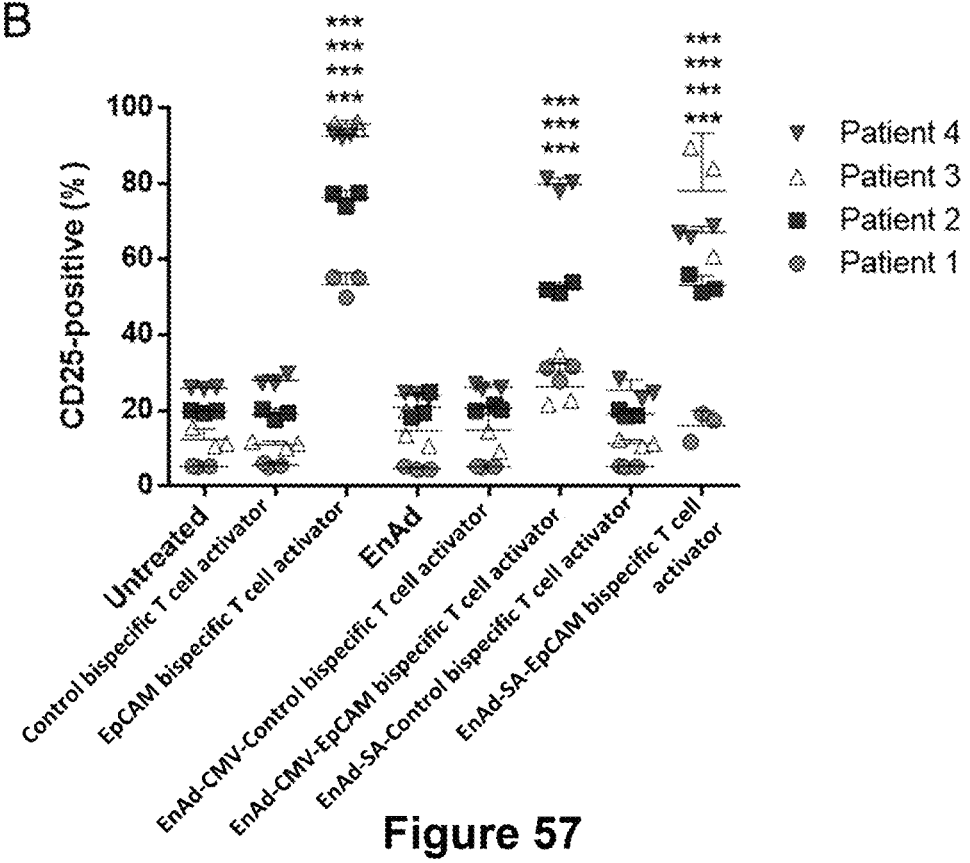
Figure 57

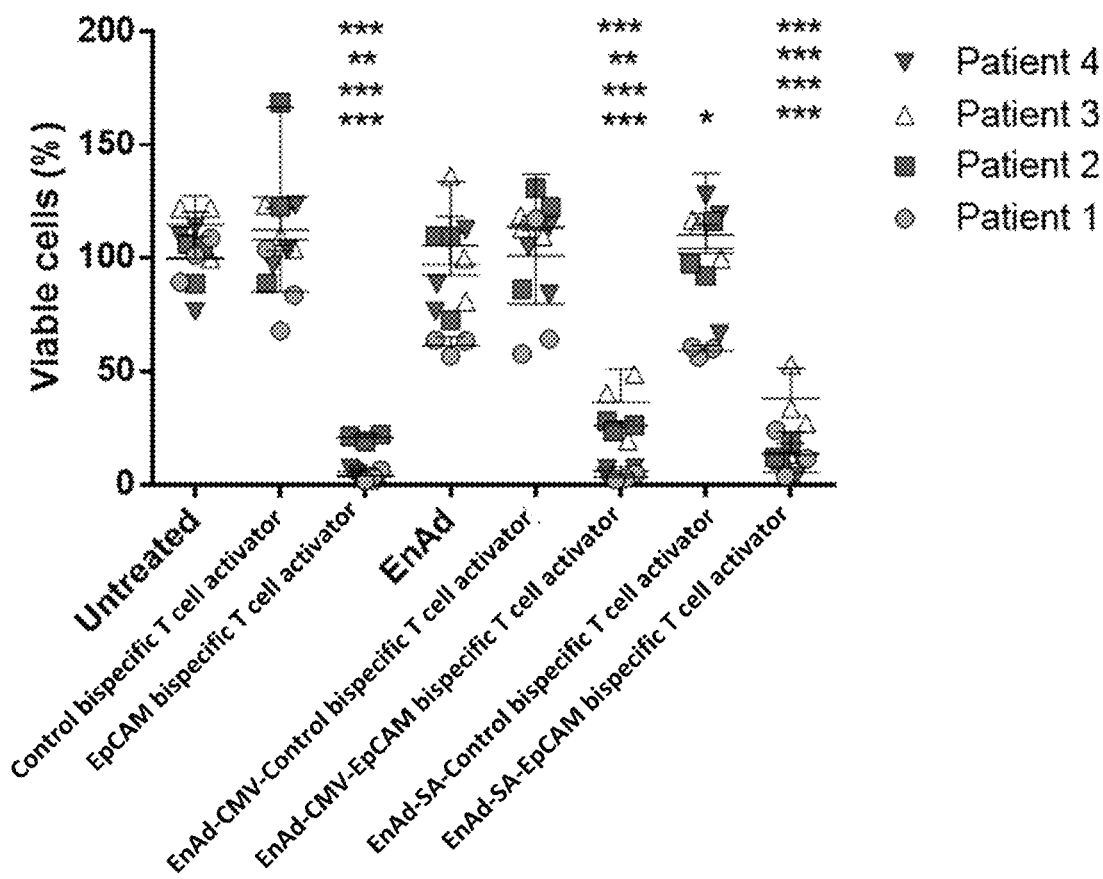
Figure 57, cont.

D EnAd
EnAd-CMV-EpCAM bispecific T cell activator
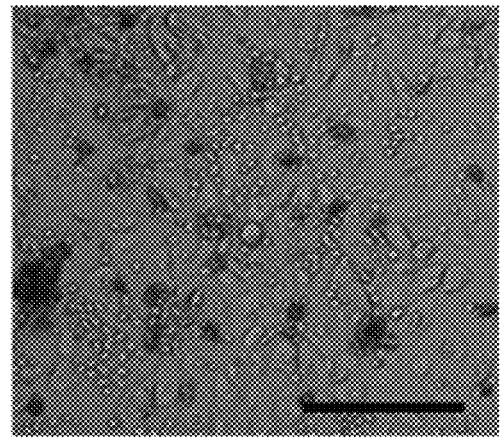
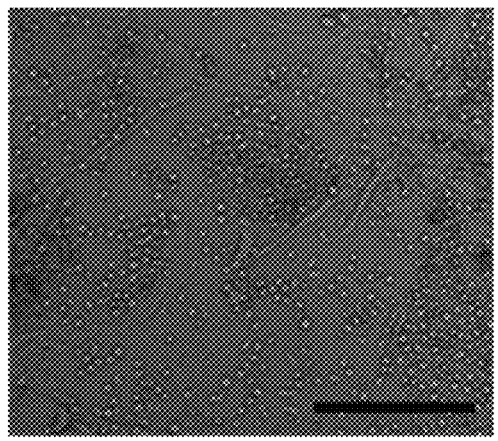
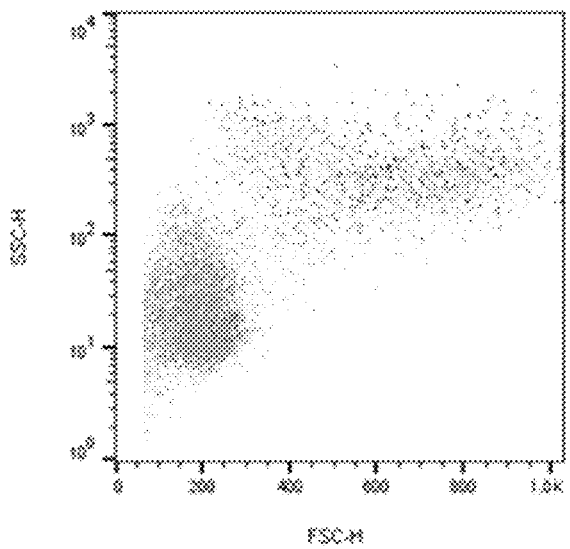
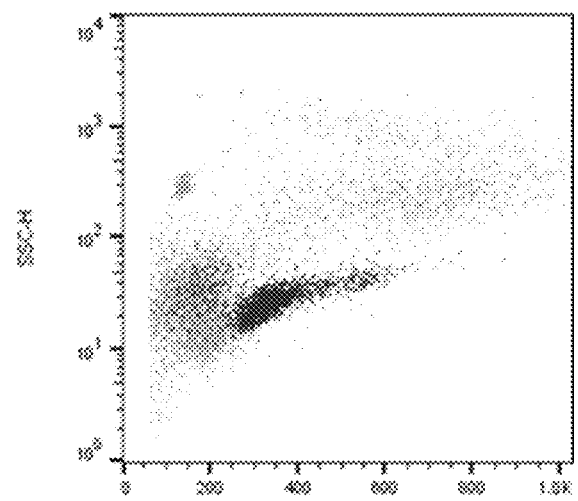
Figure 57, cont.

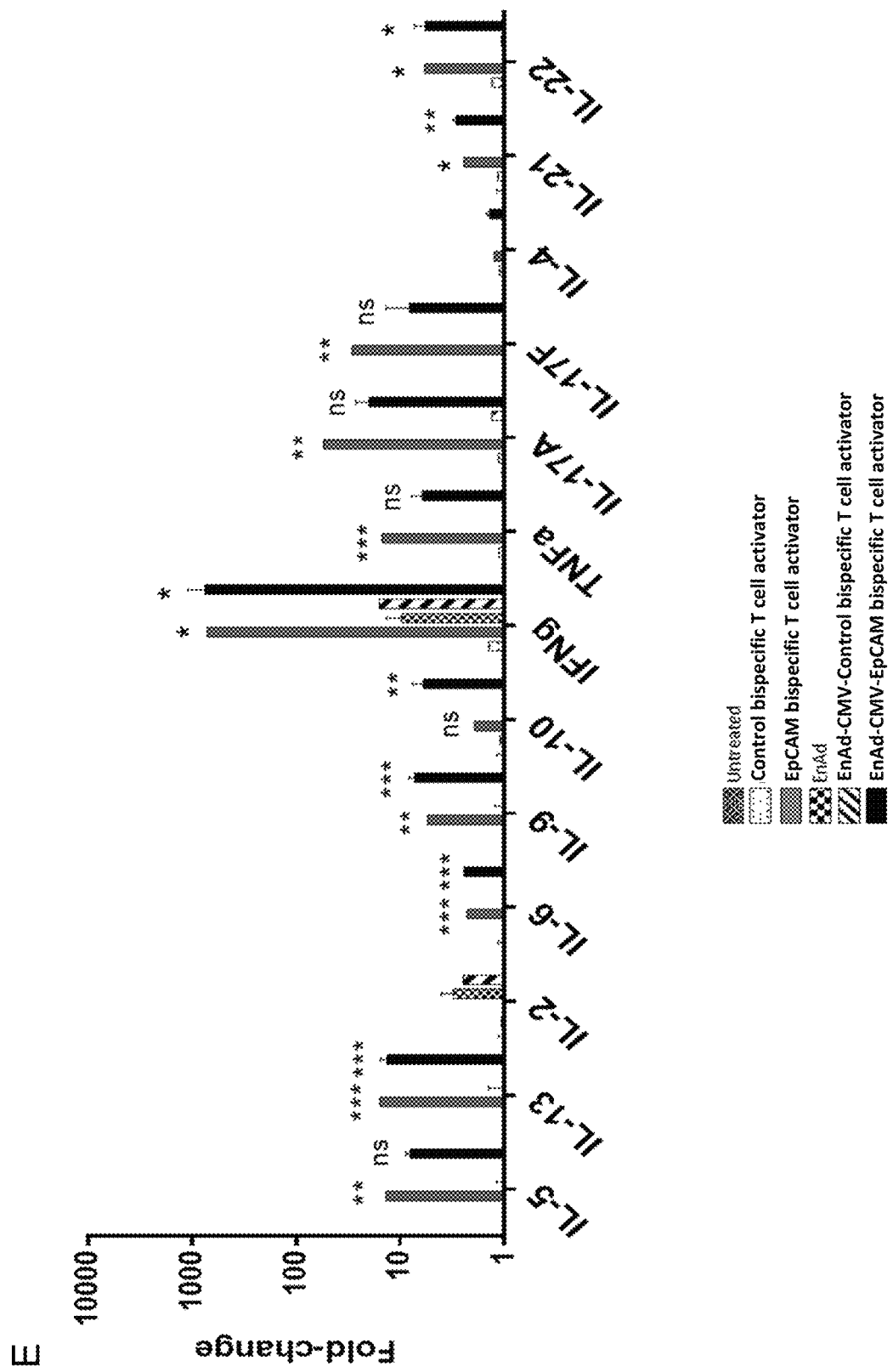
Figure 57, cont.

A

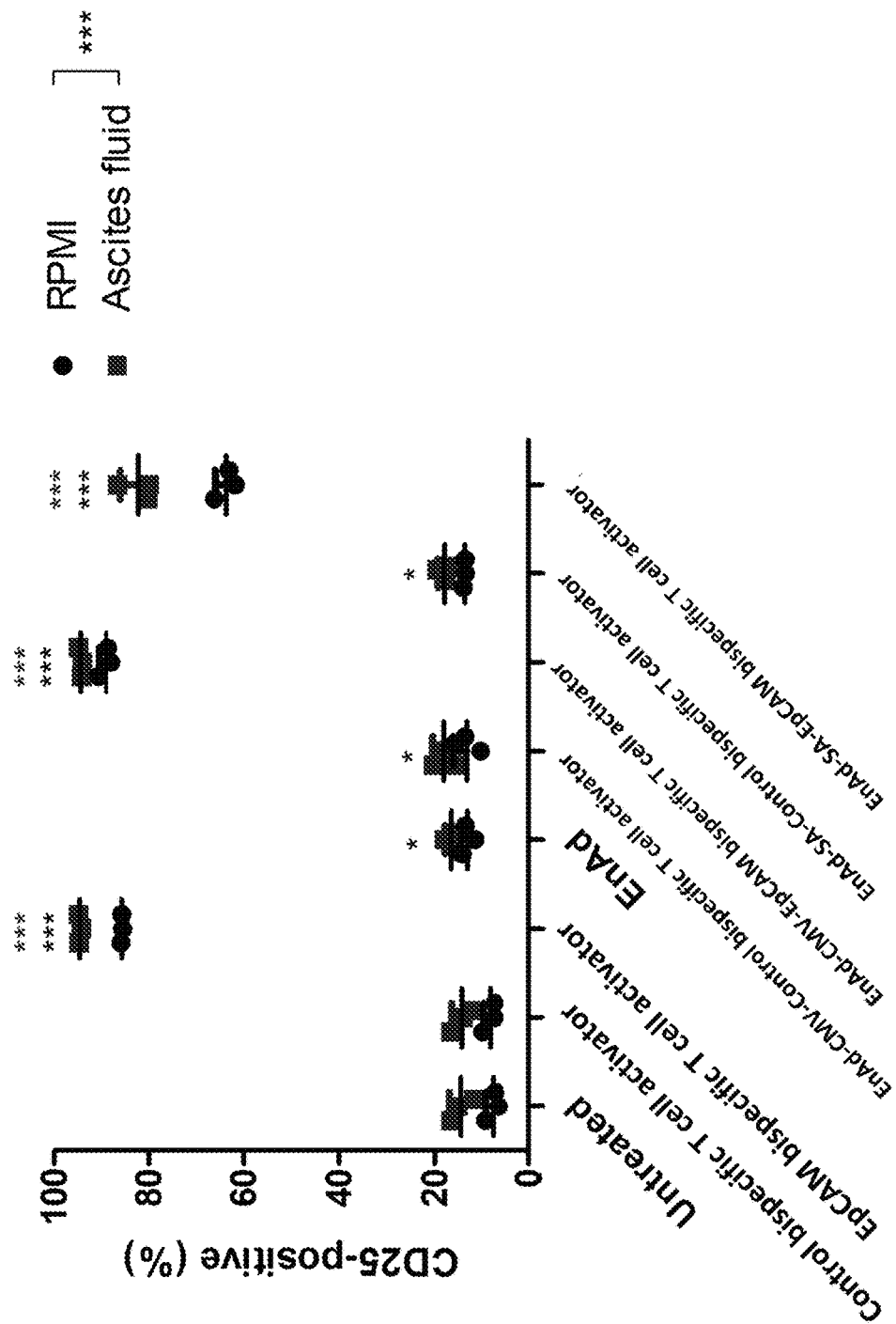
FIGURE 66, cont.

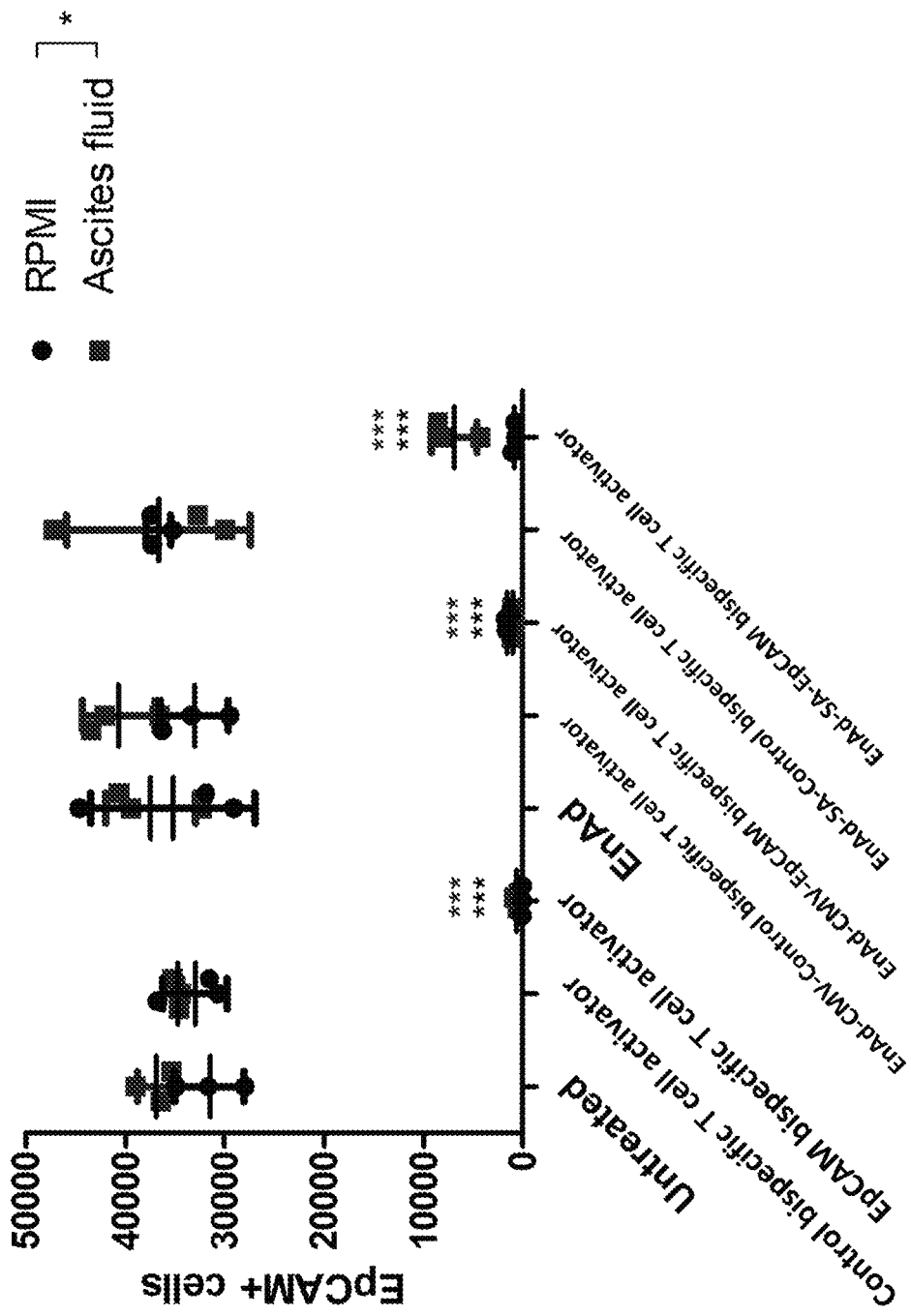
FIGURE 66, cont.

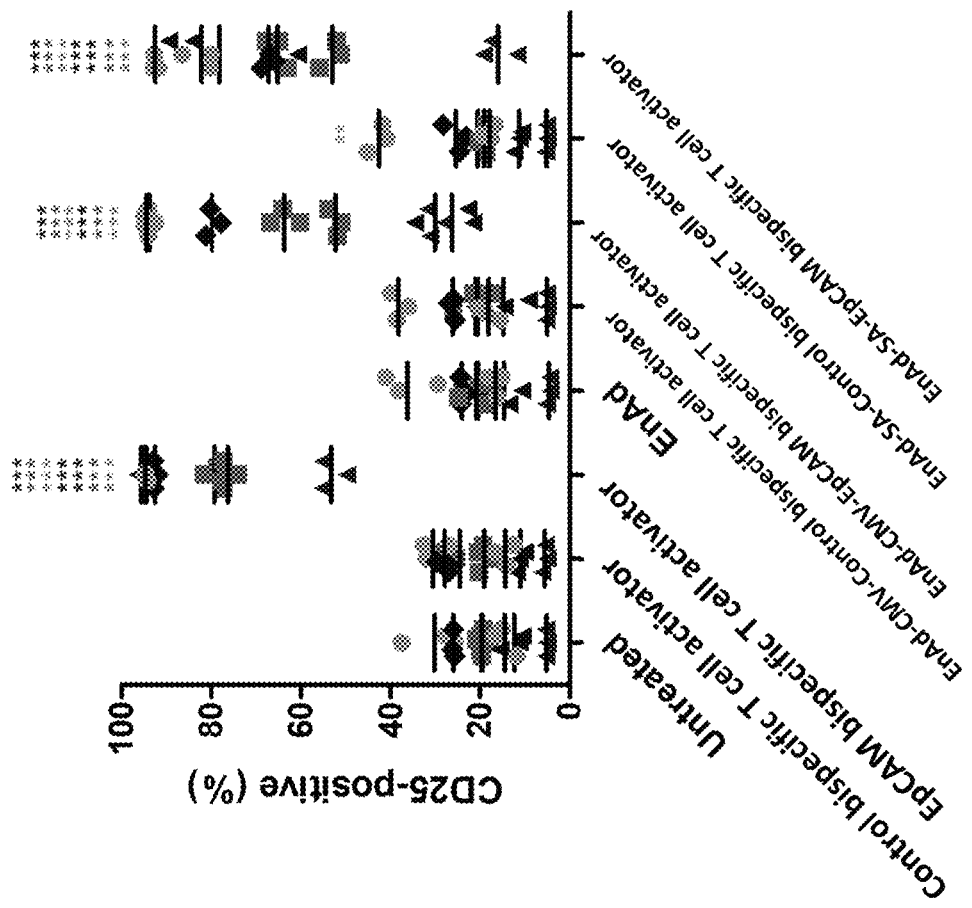
FIGURE 67, cont.
B

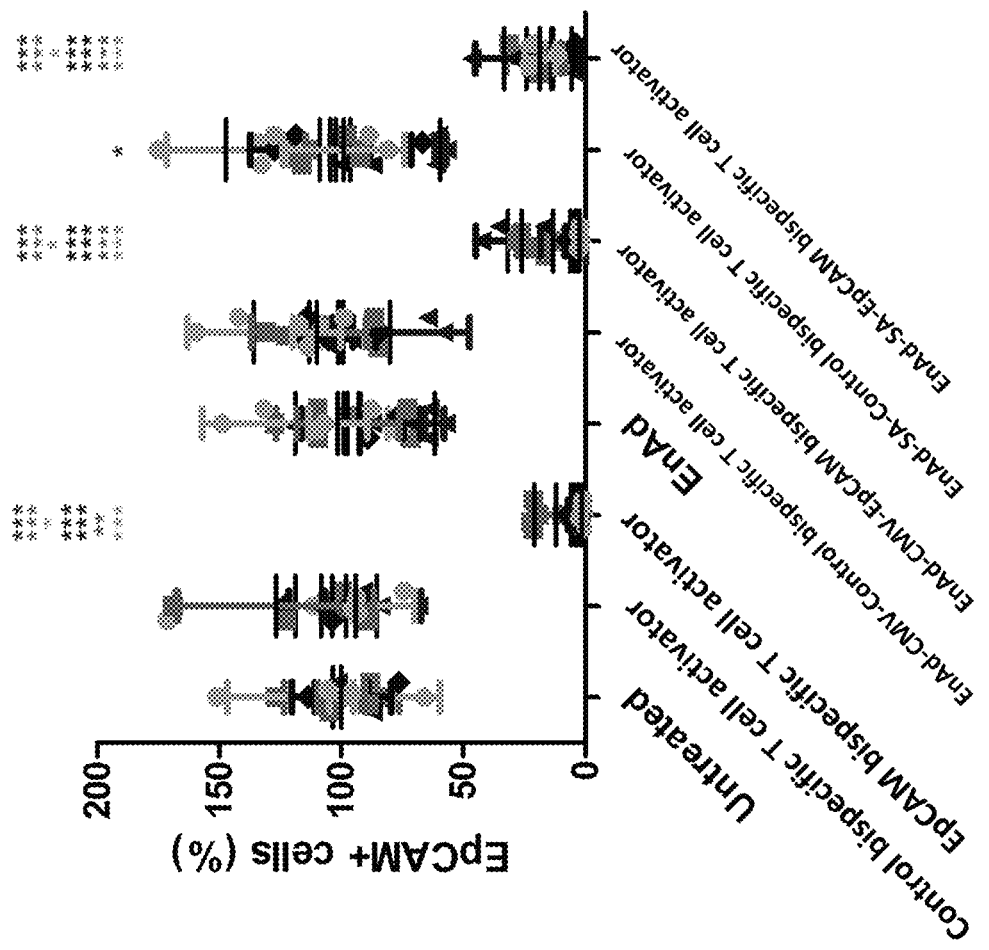
FIGURE 67, cont.
C

Figure 68
A
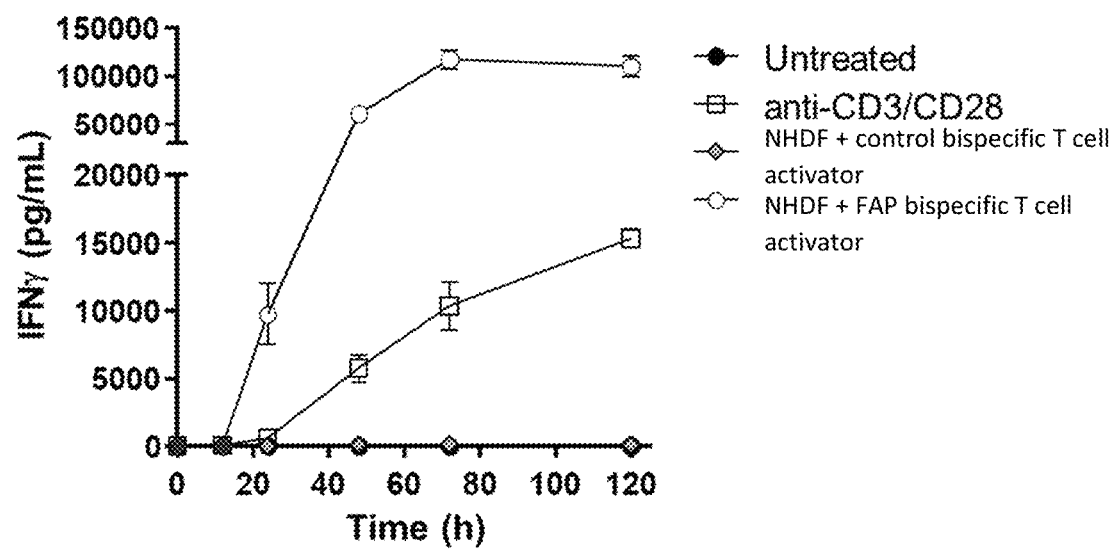
B
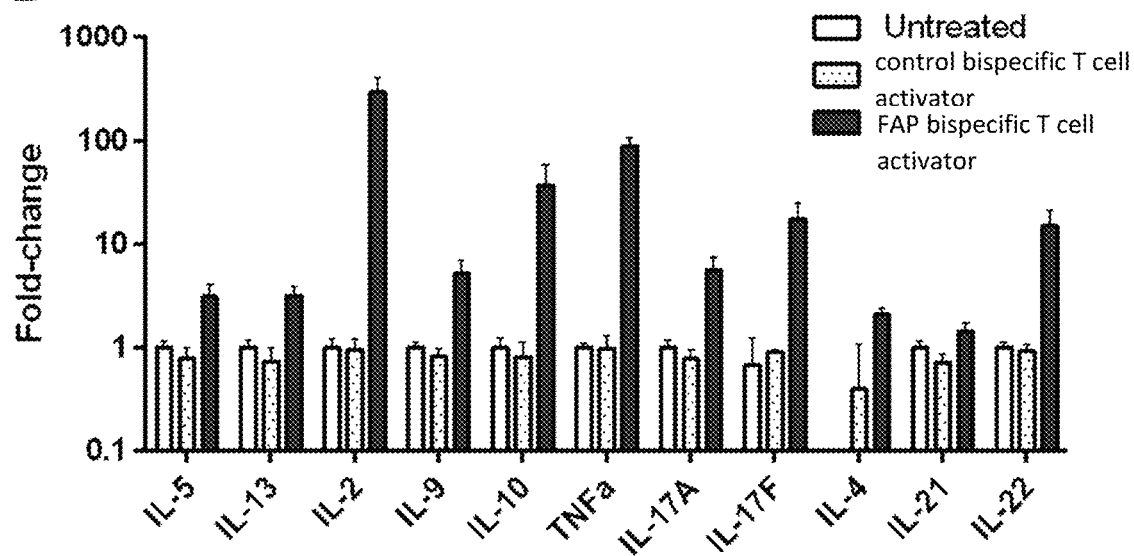

Figure 69
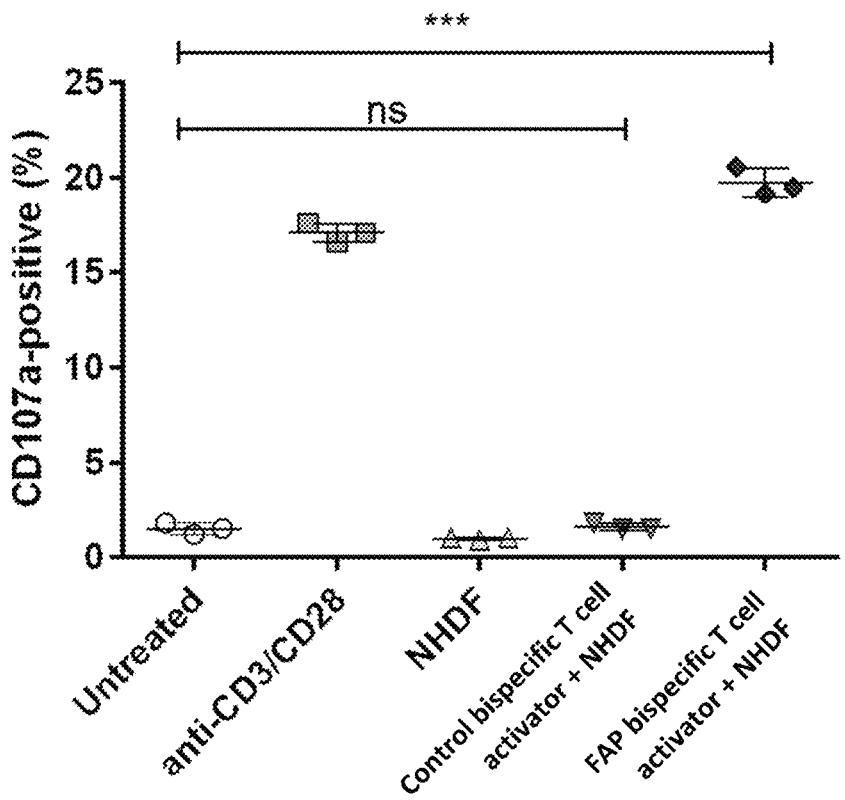
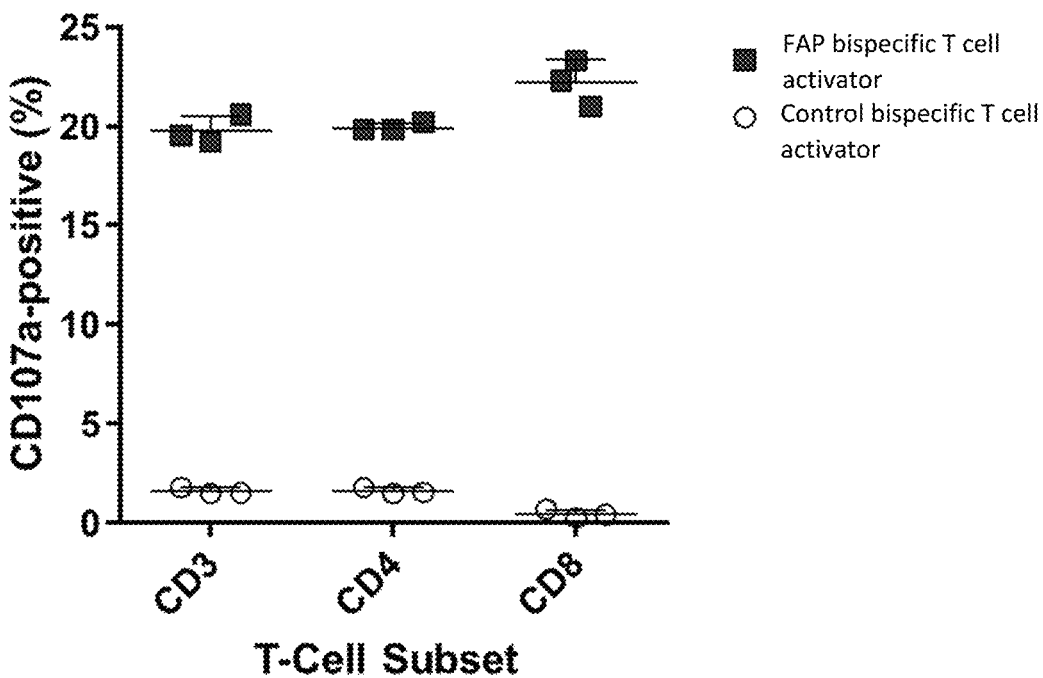

Figure 69, cont.
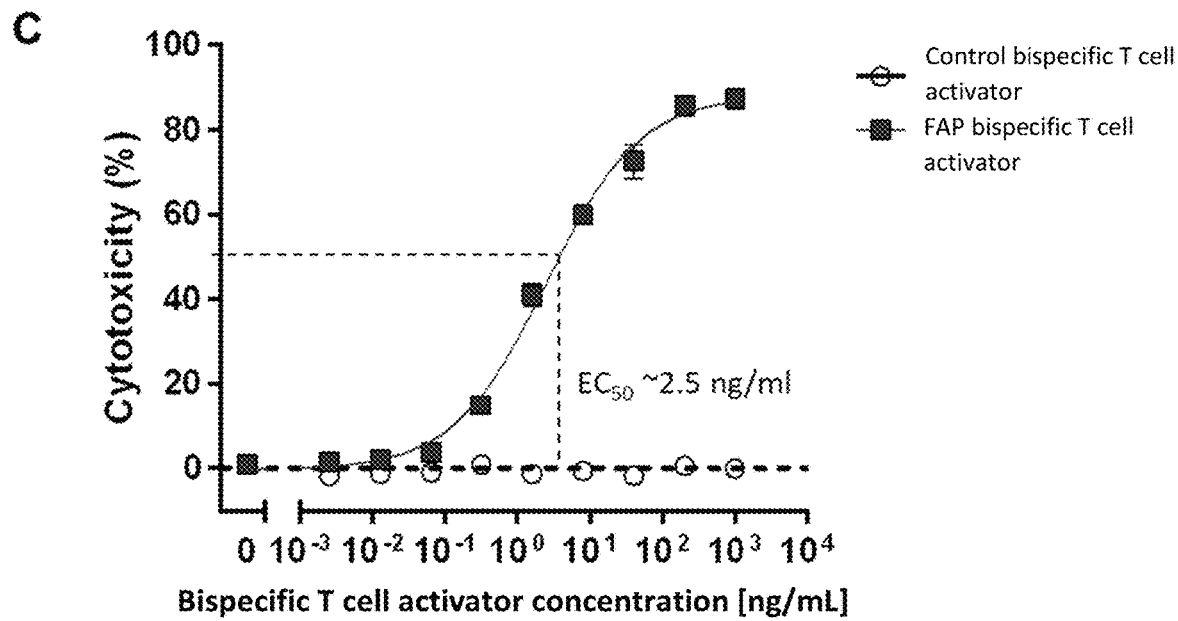
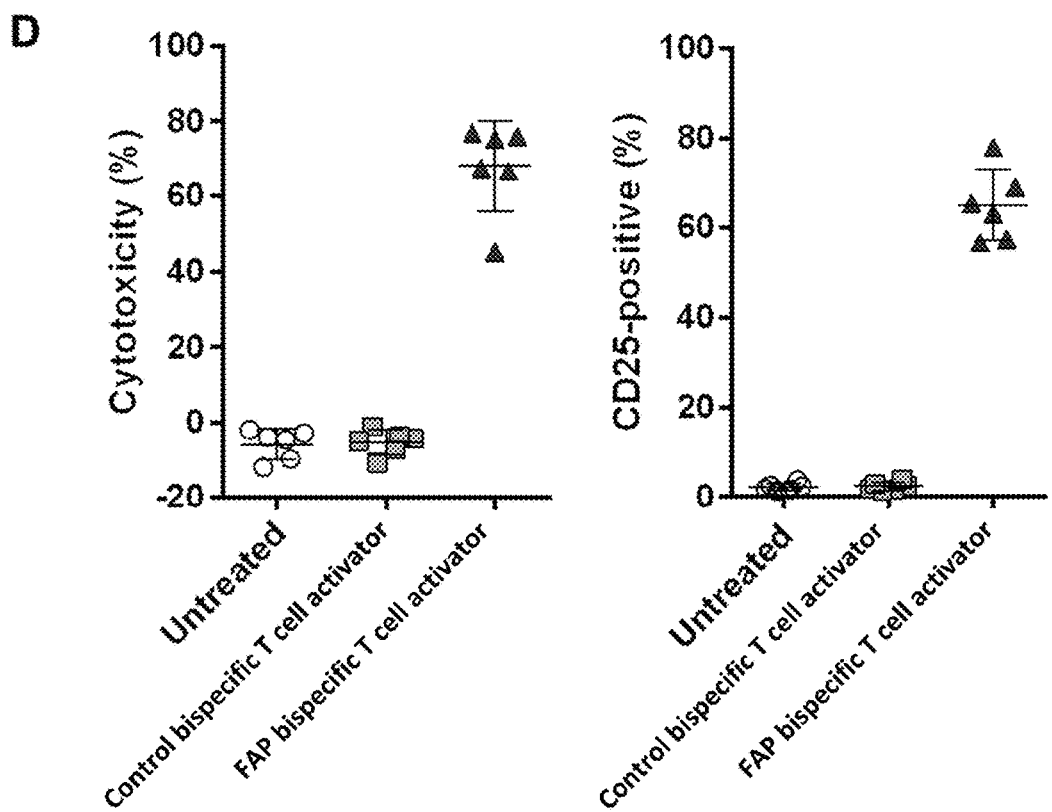

Figure 70, cont.
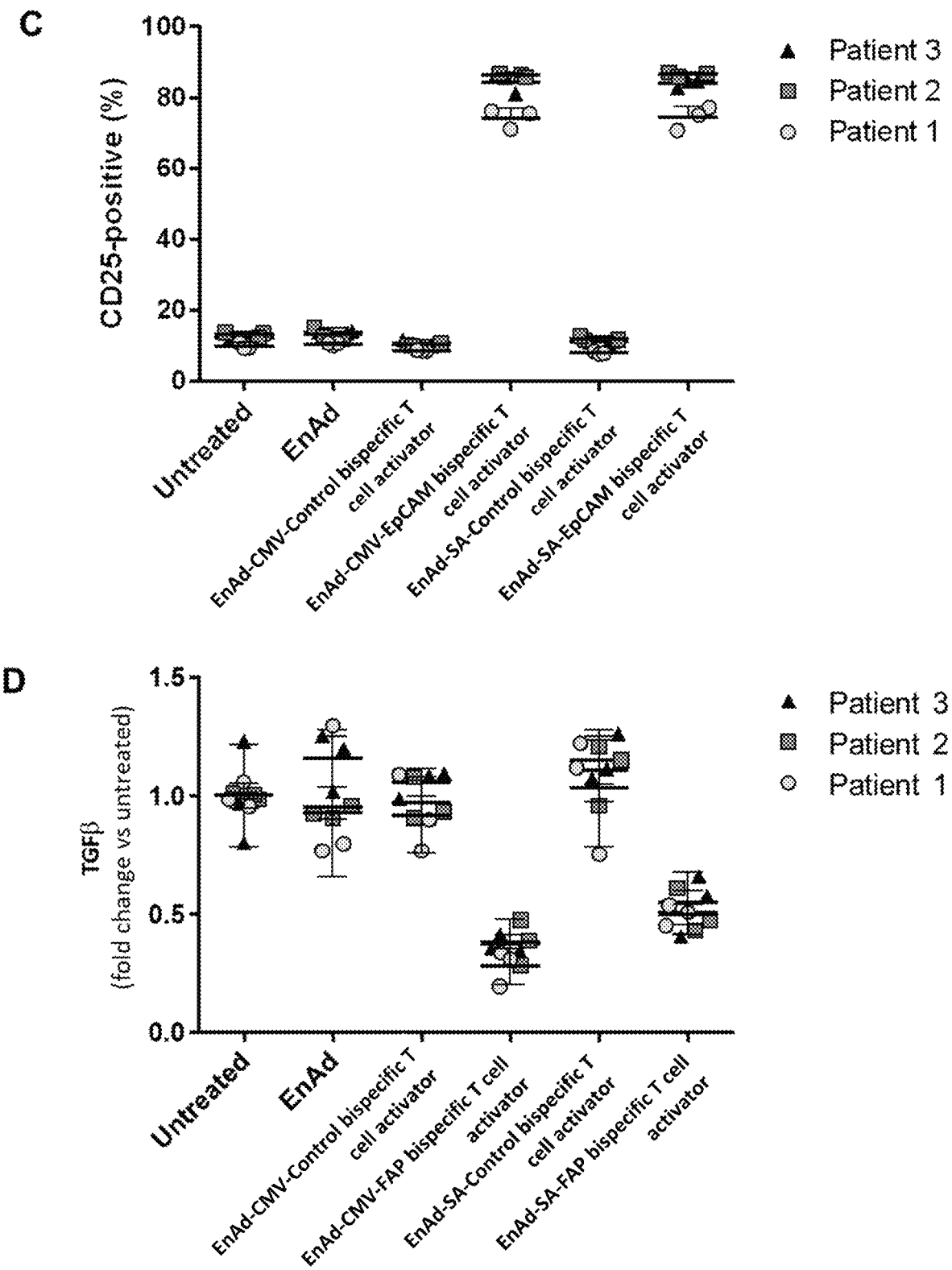

Figure 72, cont.
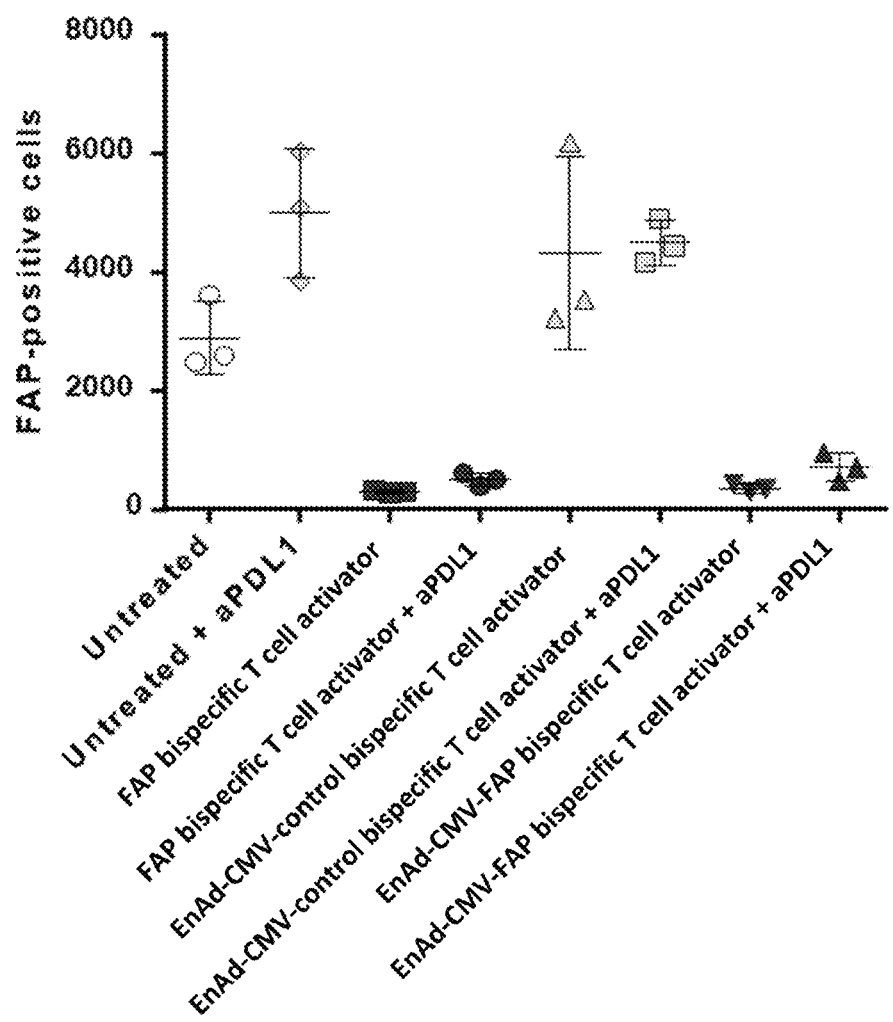

Figure 73, cont.
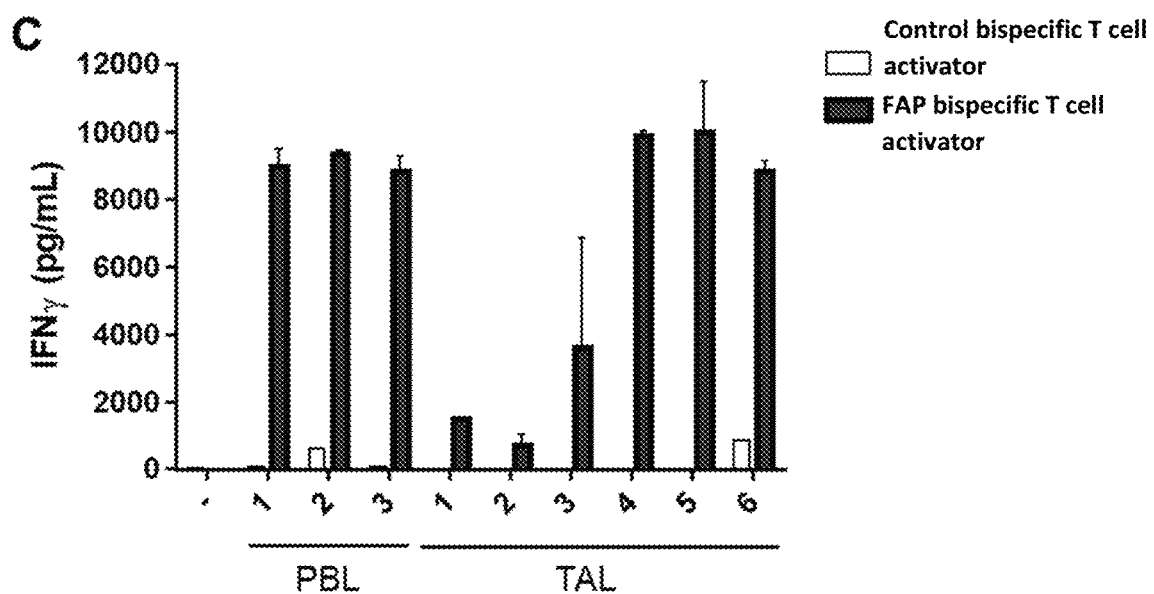
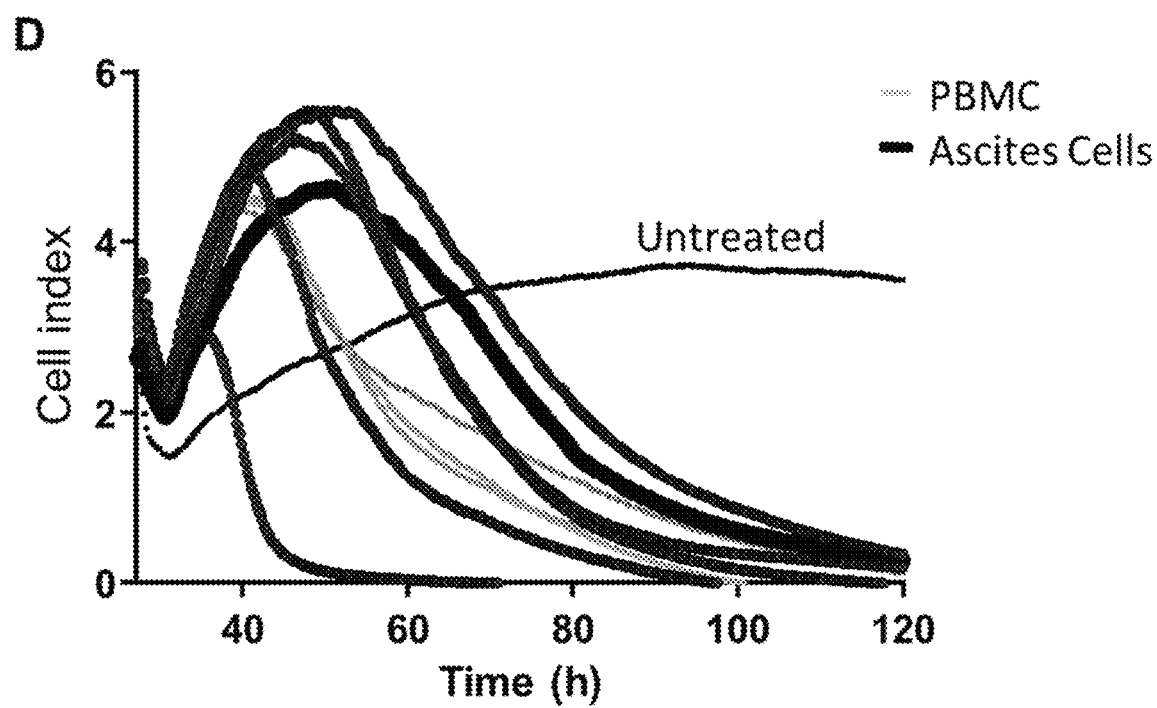

Figure 74
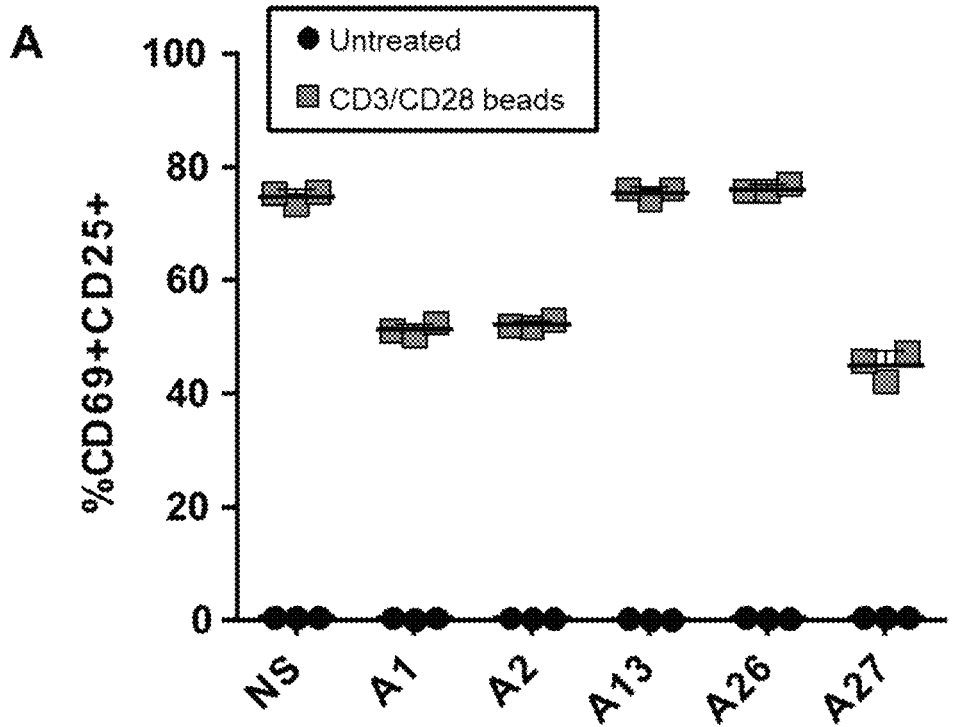
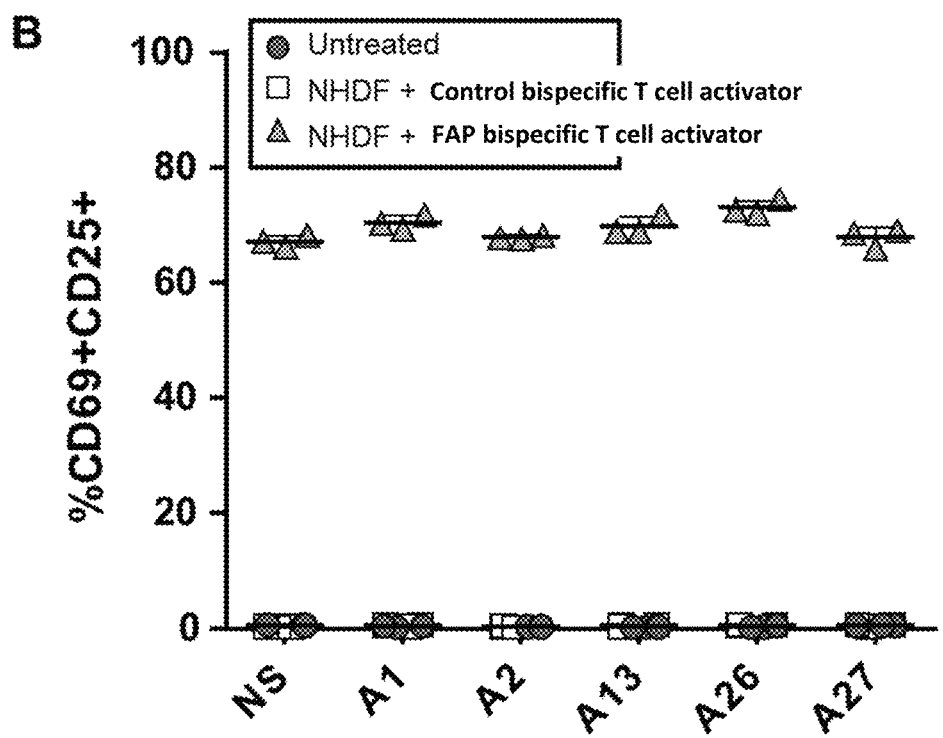

Figure 75, cont.
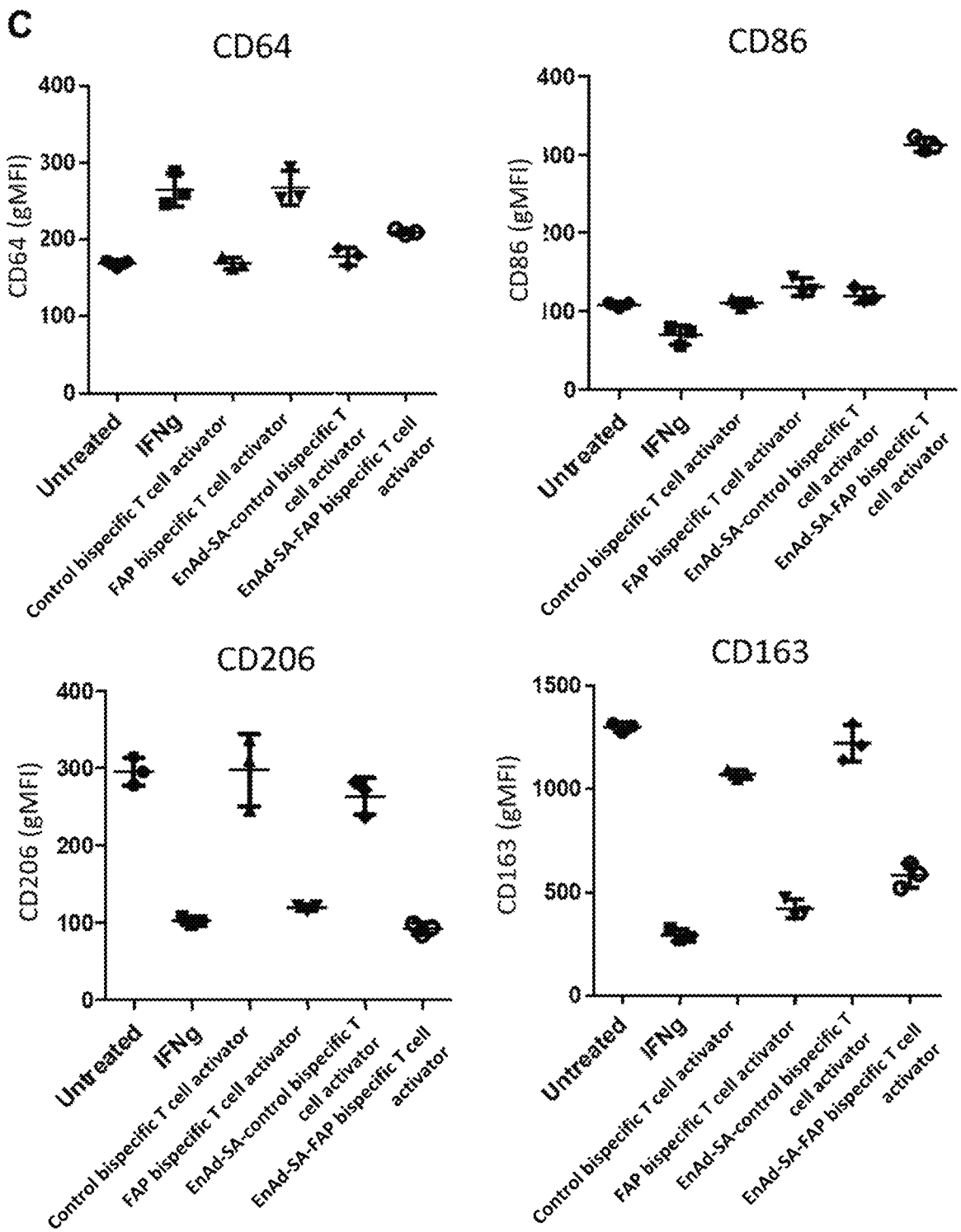

Figure 76
A  EpCAM Staining
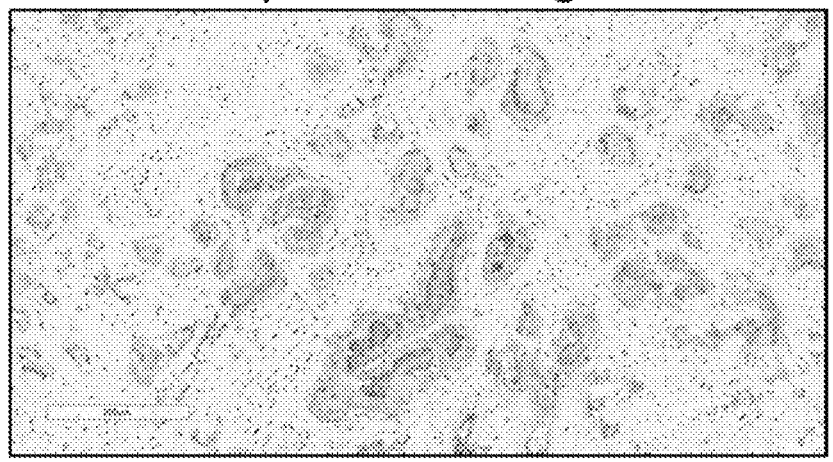
B  CD8 Staining
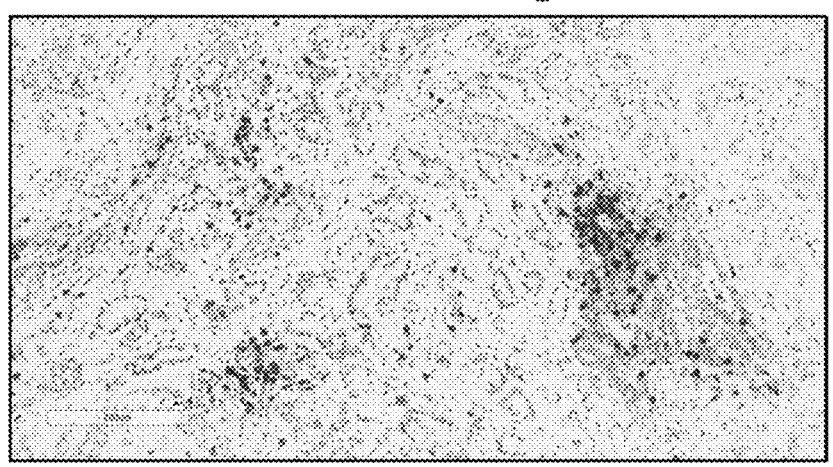
C  FAP Staining
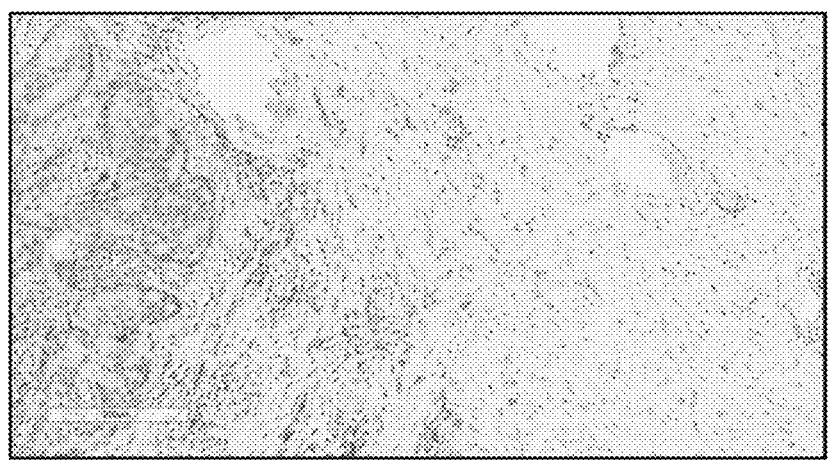

Figure 76, cont.
D
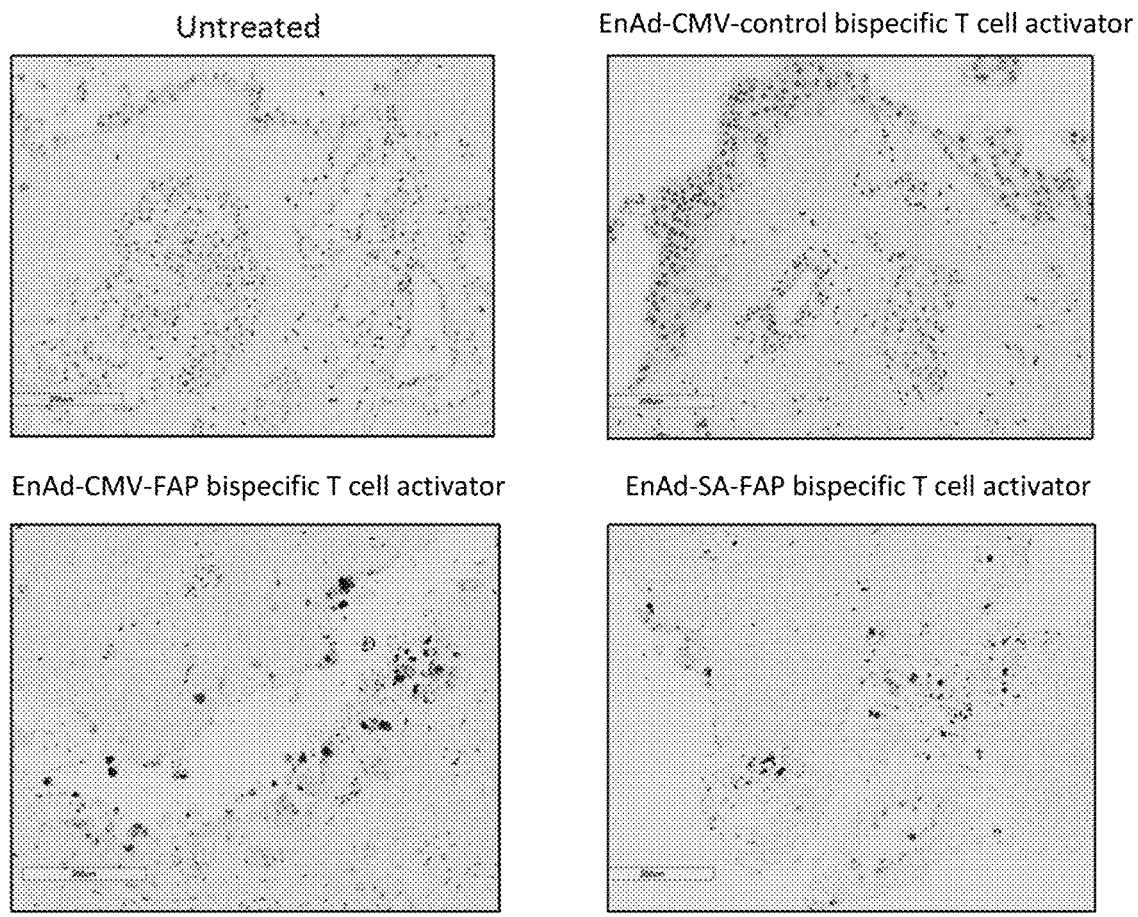

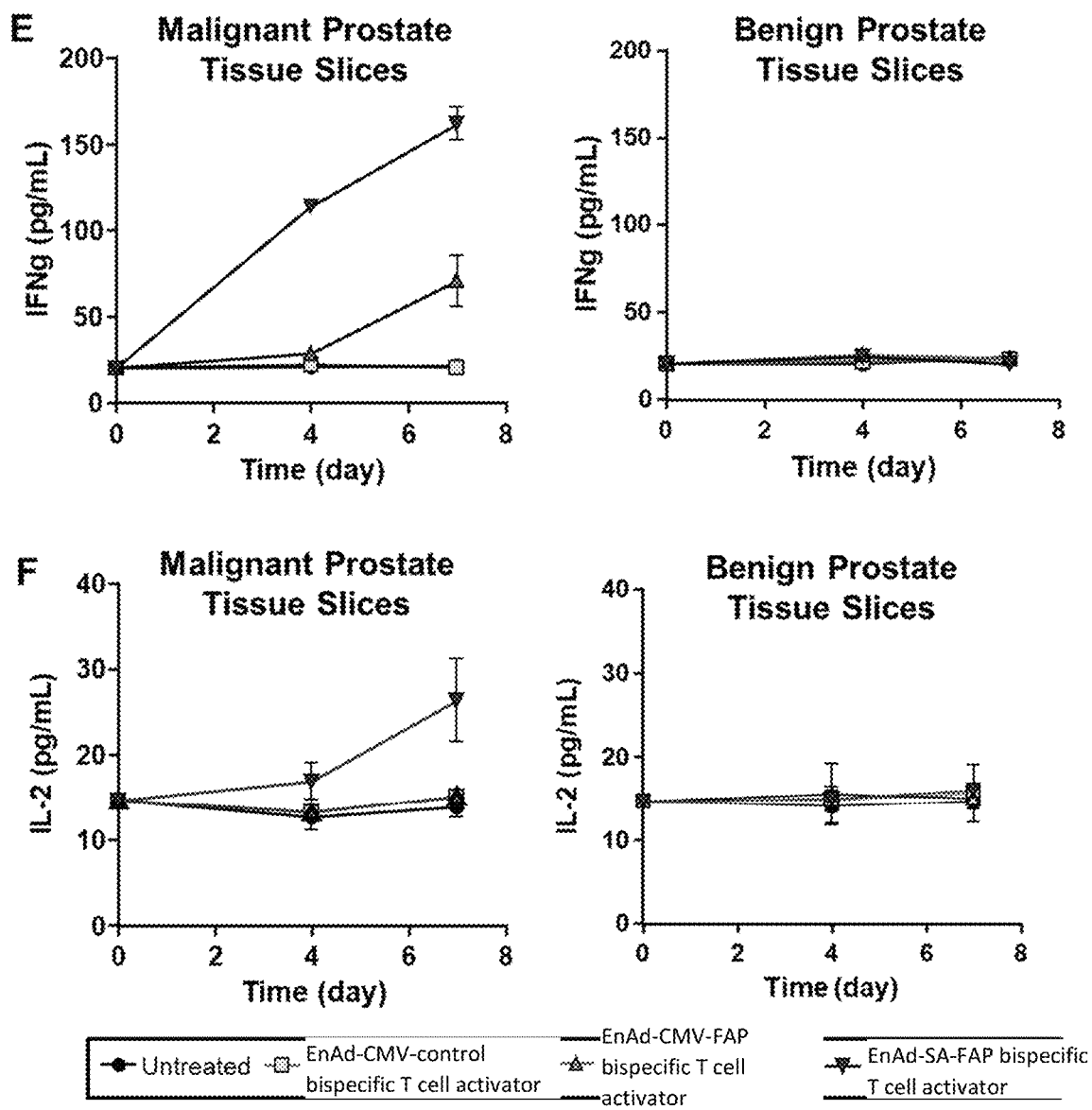
Figure 76, cont.

Figure 77
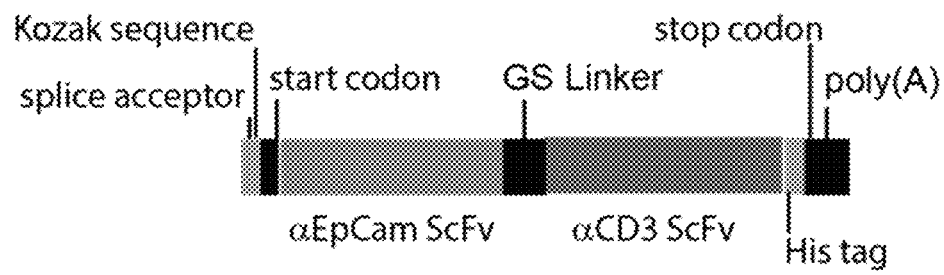
A
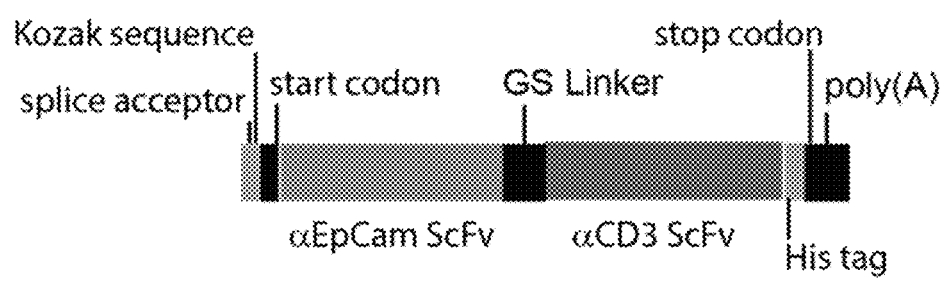
B
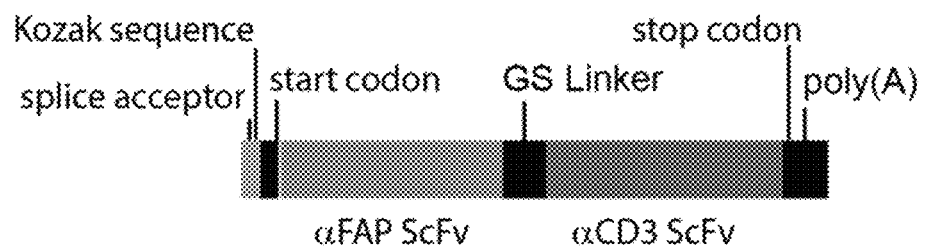
C

Figure 77, cont.
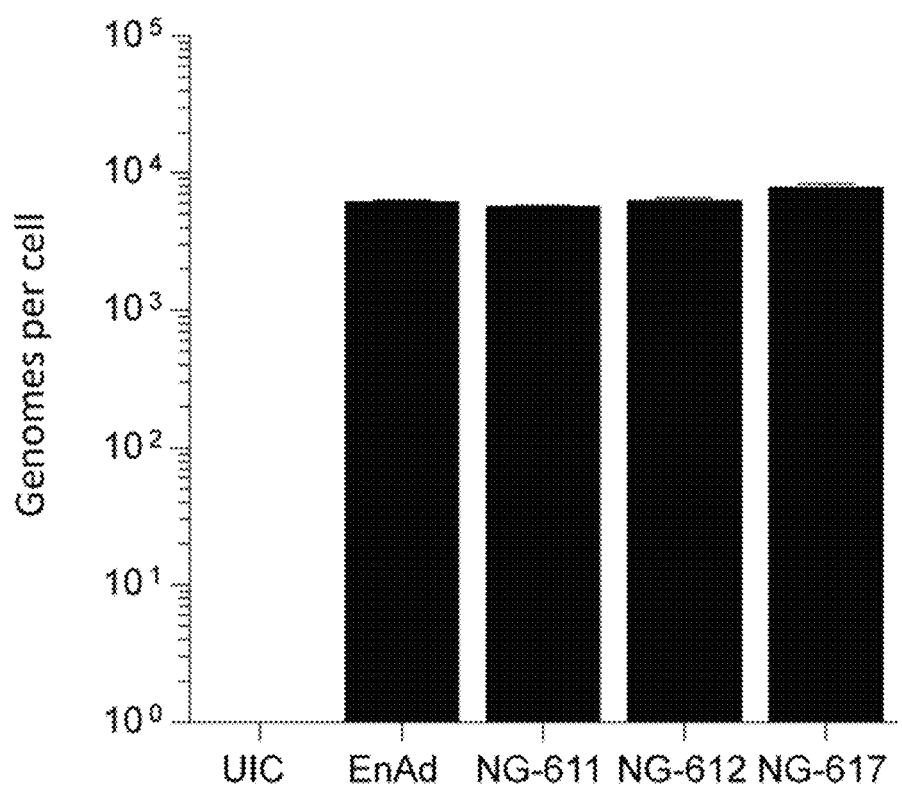

Figure 81
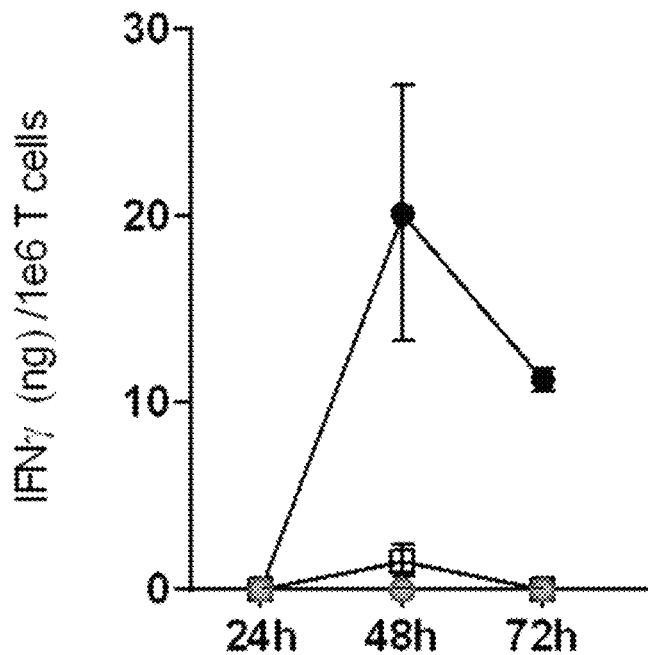
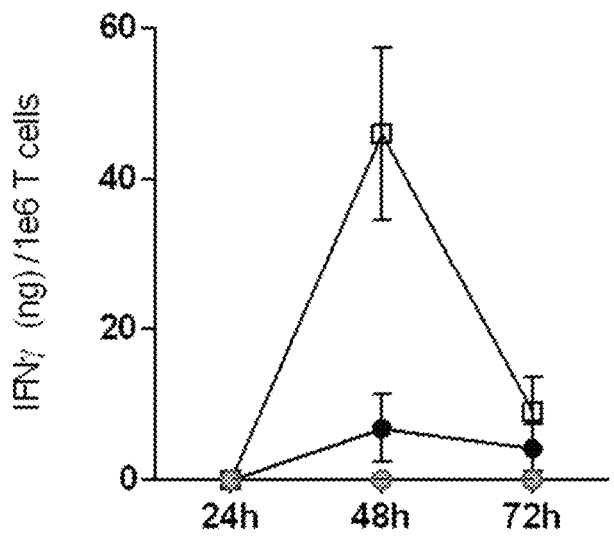
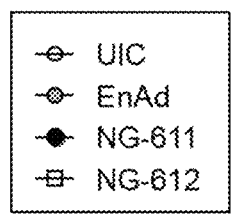

Figure 82
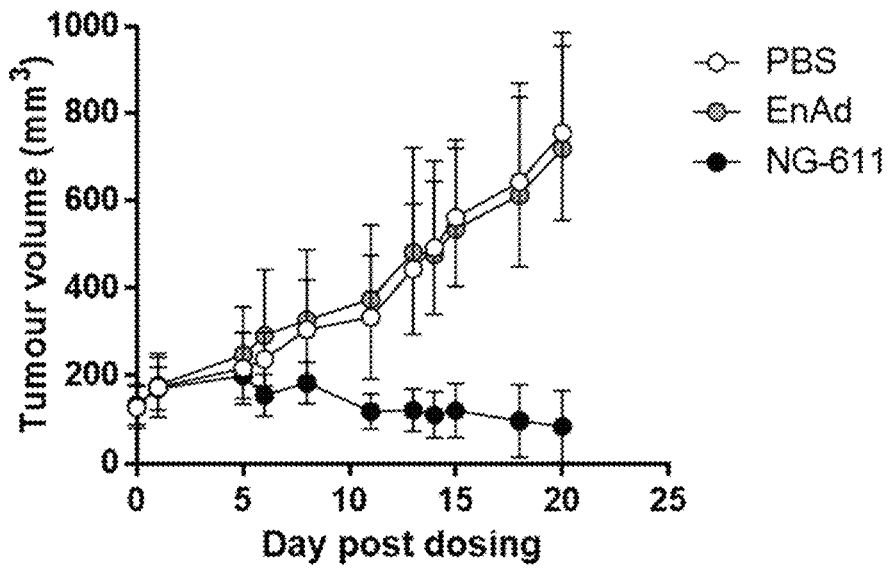
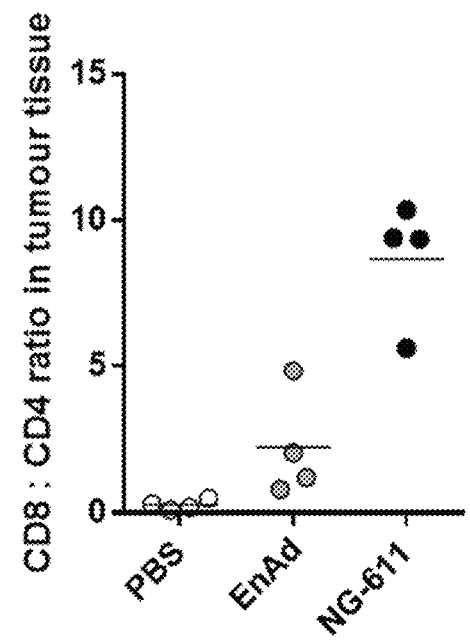

Figure 90
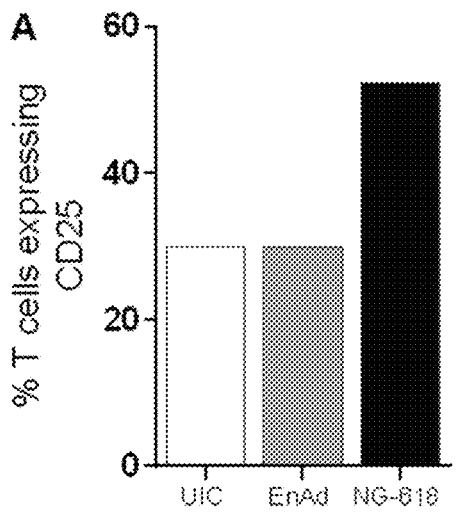
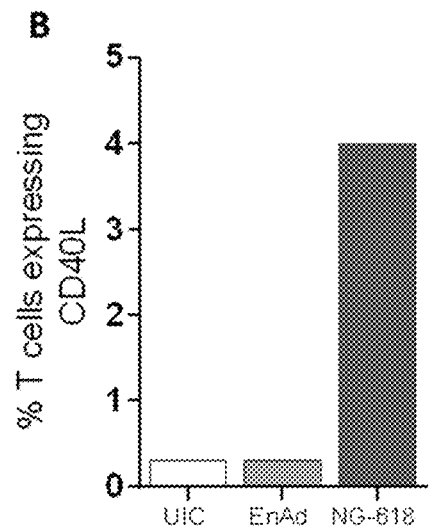
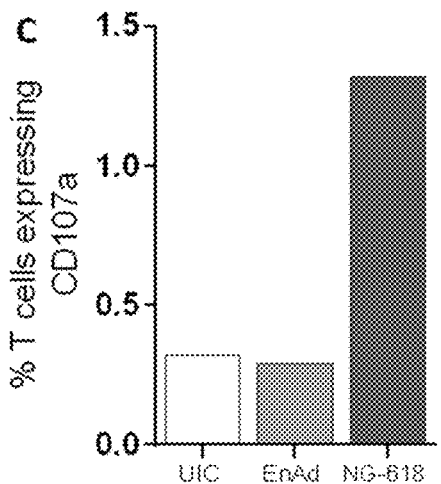

ONCOLYTIC GROUP B ADENOVIRUS EXPRESSING A STROMA-TARGETED BISPECIFIC T-CELL ENGAGER

The present disclosure relates to a modified adenovirus, in particular Enadenotucirev (EnAd), armed with a bispecific T cell activator comprising at least two binding domains, wherein at least one of the domains is specific for a surface antigen on a T-cell of interest. The disclosure further relates to a composition, such as a pharmaceutical formulation comprising the virus, use of the virus and virus formulations, particularly in treatment, especially in the treatment of cancer. The disclosure also extends to processes for preparing the virus and DNA encoding the same.

CROSS-REFERENCE TO RELATED APPLICATIONS

The present application is a 35 U.S.C. § 371 national phase application from, and claims priority to, International Application No. PCT/EP2017/071674, filed Aug. 29, 2017, and published under PCT Article 21(2) in English, which designated the U.S., and claims the benefit of priority from United Kingdom Patent Application No. GB1614607.8 filed on Aug. 29, 2016, United Kingdom Patent Application No. GB 1700663.6, filed Jan. 13, 2017, United Kingdom Patent Application No. GB 1706219.1, filed Apr. 19, 2017, and United Kingdom Patent Application No. GB 1713765.4, filed Aug. 28, 2017, each of which are incorporated by reference herein into this application in their entirety including all tables, figures and claims.

SEQUENCE LISTING

The instant application contains a Sequence Listing which has been submitted in ASCII format via EFS-Web and is hereby incorporated by reference in its entirety. Said ASCII copy, created on Dec. 15, 2021, is named 314641-00036_Sequence_Listing.txt and is 1,111,257 bytes in size.

BACKGROUND

Cancer is still a huge social burden to society in terms of the hardship and suffering of patients and their loved ones, and also in terms of the high financial cost of treating, caring for and supporting patients.

A large variety of therapies have been developed for the treatment of cancer including chemotherapeutic agents, radiotherapy and more recently biologics such as antibodies. Antibody-based therapy for cancer has become established over the past 15 years and is now one of the most successful and important strategies for treating patients with haematological malignancies and solid tumours. Examples of monoclonal antibody based anti-cancer therapies currently in clinical use include rituximab, which targets CD20, bevacizumab which targets VEGF, cetuximab which targets EGFR and labetuzumab which targets CEA.

Amongst the various antibody formats developed, bispecific T-cell activators show much promise. These are relatively simple bi-specific molecules that are specific for the CD3ε subunit of the TCR complex of a T-cell and also a target an antigen of interest, such as a cancer antigen. Since bispecific T-cell activators are specific for the TCR complex, this enables them to activate resident T-cells to kill cells expressing a particular target antigen on their cell surface, for example cancer cells. An important property of bispecific T-cell activator's is their ability to make $CD4^+$ and non-activated $CD8^+$ T-cells target cancer cells. In other words, T-cells activated by bispecific T-cell activators can be made to kill cells independent of MHC expression on the cell surface. This is important because some tumour cells down-regulate MHC which makes them resistant to agents such as CAR-T cells and immTACs.

Unfortunately, bispecific T-cell activators have poor circulation kinetics relative to full length antibodies. This means that when administered to the patient, a large proportion of the bispecific T-cell activators do not reach their target cells. In addition, the use of high affinity anti-CD 3 ScFv as part of the bispecific T-cell activator can lead to strong binding to T-cells in the blood, which also interferes with delivery to the tumour. As a result, the Bispecific T-cell activators are unable to reach their full potential as an anti-cancer therapy because they cannot be effectively delivered to the tumour cells.

The requirement for effective delivery of therapeutic agents, such as Bispecific T-cell activators, to tumour cells has become increasingly important since it is becoming more apparent that solid tumours protect themselves in vivo in a number of ways, for example by developing stroma around the tumour. Progression to a carcinoma is associated with proliferation of epithelial cells (mitotic cells) along with the development of an activated tumour stroma. In this case, extracellular-matrix (ECM) components such as collagen bundles are degraded, because of increased turnover. The number of inflammatory cells increases and fibroblasts differentiate into myofibroblasts, resulting in their expression of growth factors, matrix components and degrading proteases. Angiogenesis is maintained, resulting in a high number of leaky tumour vessels. Following activation of a tumour stroma with persistent angiogenesis, invasion by tumour cells begins through the degraded basement membrane, and blood vessels infiltrate the tumour tissue.

This stroma is a physical protection in that it may have a function of trapping immune cells sent to fight the tumour. In addition the stroma shields the hypoxic microenviroment of the tumour, which is permissive and optimised for the tumour's growth. There are some theories that cells in the stroma are a source of energy in the tumour.

A large component of tumour stroma are fibroblasts, which have been corrupted to serve the purpose of the cancer. Other cells that infiltrate the stroma are tumour associated macrophages (TAMs), which are type 2 (M2) macrophages that can promote tumour growth by secreting cytokines and chemokines, such as IL-10 that suppress immune responses.

It is especially difficult to target the tumour stroma because the cells that make the environment are "native" immune or connective tissue cells, which are found throughout the body. Thus, targeting these cells with therapeutic agents can lead to serious off-target effects.

Hence, there is a need for an improved method of delivering a bispecific T-cell activator directly to tumour cells where it can provide maximal therapeutic benefit, in particular delivery to tumour cells surrounded by stromal fibroblasts.

SUMMARY OF INVENTION

The present inventors believe that one of the most effective ways to deliver the therapeutic agents directly to the tumour is with an oncolytic adenovirus engineered to express agents that, for example activate T cells and target an antigen, such as in the stroma.

Accordingly, the present disclosure provides an adenovirus comprising a sequence of formula (I):

5'ITR-$B_1$-$B_A$-$B_2$-$B_X$-$B_B$-$B_Y$-$B_3$-3'ITR (I)

wherein:
$B_1$ is bond or comprises: E1A, E1B or E1A-E1B;
$B_A$ comprises-E2B-L1-L2-L3-E2A-L4;
$B_2$ is a bond or comprises: E3;
$B_X$ is a bond or a DNA sequence comprising: a restriction site, one or more transgenes or both;
$B_B$ comprises L5;
$B_Y$ is a bond or a DNA sequence comprising: a restriction site, one or more transgenes or both;
$B_3$ is a bond or comprises: E4;
wherein the adenovirus encodes a Bispecific T cell Activator comprising at least two binding domains wherein at least one of the said domains is specific to a surface antigen on an immune cell of interest, such as a T cell of interest; and wherein the adenovirus is EnAd or Ad11.

The bispecific T-cell activator or bispecific T-cell activators of according to the present disclosure do not comprise a transmembrane domain and so are not expressed on the cancer cell surface but rather comprises a signal sequence to facilitate release of the Bispecific T-cell activator molecule from the cancer cell.

The following paragraphs are a summary of the present disclosure:

1. An adenovirus comprising a sequence of formula (I):

5'ITR-$B_1$-$B_A$-$B_2$-$B_X$-$B_B$-$B_Y$-$B_3$-3'ITR (I)

wherein:
$B_1$ is bond or comprises: E1A, E1B or E1A-E1B;
$B_A$ comprises-E2B-L1-L2-L3-E2A-L4;
$B_2$ is a bond or comprises: E3;
$B_X$ is a bond or a DNA sequence comprising: a restriction site, one or more transgenes or both;
$B_B$ comprises L5;
$B_Y$ is a bond or a DNA sequence comprising: a restriction site, one or more transgenes or both;
$B_3$ is a bond or comprises: E4;
wherein the adenovirus encodes a Bispecific T cell Activator comprising at least two binding domains wherein at least one of the said domains is specific to a surface antigen on an immune cell of interest, such as a T cell of interest; and wherein the adenovirus is EnAd or Ad11.

2. An adenovirus according to paragraph 1, wherein the adenovirus is EnAd.
3. An adenovirus according to paragraph 1 or 2, wherein the surface antigen is a component of the T-cell receptor complex (TCR), such as CD3, TCR-α and TCR-β.
4. An adenovirus according to paragraph 3, wherein the surface antigen is CD3 such as CD3E, CD3γ and CD3δ, in particular CD3ε.
5. An adenovirus according to any one of paragraphs 1 to 4, wherein one of the binding domains is specific to a tumour antigen such as CEA, MUC-1, EpCAM, HER receptors HER1, HER2, HER3, HER4, PEM, A33, G250, carbohydrate antigens Le$^y$, Le$^x$, Le$^b$, PSMA, TAG-72, STEAP1, CD166, CD24, CD44, E-cadherin, SPARC, ErbB2 and ErbB3.
6. An adenovirus according to paragraph 5, wherein one of the binding domains is specific to EpCAM, for example an EpCAM comprising an amino acid sequence as set forth in SEQ ID NO: 28.
7. An adenovirus according to any one of paragraphs 1 to 4, wherein one of the binding domains is specific to a tumour stromal antigen, for example fibroblast activation protein (FAP), TREM1, IGFBP7, FSP-1, platelet-derived growth factor-α receptor (PDGFR-α), platelet-derived growth factor-Preceptor (PDGFR-β) and vimentin.
8. An adenovirus according to paragraph 7, wherein one of the binding domains is specific to FAP, for example a FAP comprising an amino acid sequence as set forth in SEQ ID NO: 30.
9. A adenovirus according to paragraph 7 or 8, wherein the stromal antigen is an antigen is selected from a myeloid derived suppressor cell antigen, a tumor associated macrophage, and combinations thereof 10. An adenovirus according to paragraph 9, wherein the antigen is selected from CD163, CD206, CD68, CD11c, CD11b, CD14, CSF1 Receptor, CD15, CD33, CD66b and a combination of two or more of the same.
11. An adenovirus according to any one of paragraphs 1 to 3 and 5 to 10, wherein one of the binding domains in the bispecific T-cell activator is specific to a non-TCR activating protein such as CD31, CD2 and CD277.
12. An adenovirus according to any one of paragraphs 1 to 11, wherein at least one of $B_X$ or $B_Y$ is not a bond.
13. An adenovirus according to any one of paragraphs 1 to 12, wherein the adenovirus is chimeric.
14. An adenovirus according to any one of paragraphs 1 to 13, wherein the adenovirus is oncolytic.
15. An adenovirus according to any one of paragraphs 1 to 14, wherein the adenovirus replication capable.
16. An adenovirus according to paragraph 13, wherein the adenovirus is replication competent.
17. An adenovirus according to any one of paragraphs 1 to 14, wherein the adenovirus is replication deficient.
18. An adenovirus according to any one of paragraphs 1 to 17, wherein $B_X$ comprises one or more transgenes or a transgene cassette.
19. An adenovirus according to any one of paragraphs 1 to 16, wherein $B_Y$ comprises one or more transgenes or a transgene cassette.
20. An adenovirus according to any one of paragraphs 1 to 19, wherein the one or more transgenes or transgene cassettes is under the control of an endogenous or exogenous promoter, such as an endogenous promoter.
21. An adenovirus according to paragraph 20, wherein the transgene or transgene cassette is under the control of an endogenous promoter selected from the group consisting of E4 promoter and major late promoter, in particular the major late promoter.
22. An adenovirus according to paragraph 19, wherein the transgene or transgene cassette is under the control of an exogenous promoter, such as CMV.
23. An adenovirus according to any one of paragraphs 1 to 22, wherein the transgene cassette further comprises a regulatory element independently selected from:
   a. a splice acceptor sequence,
   b. an internal ribosome entry sequence or a high self-cleavage efficiency A peptide,
   c. a Kozak sequence, and
   d. combinations thereof
24. An adenovirus according to paragraph 23, wherein the transgene cassette comprises a Kozak sequence which is at the start of the protein coding sequence.
25. An adenovirus according to any one of claims 1 to 24, wherein the transgene cassette encodes a high self-cleavage efficiency A peptide.

26. An adenovirus according to any one of paragraphs 1 to 25, wherein the transgene cassette further comprises a polyadenylation sequence.
27. An adenovirus according to any one of paragraphs 1 to 26, wherein the transgene cassette further comprises a restriction site at the 'end of the DNA sequence and/or at the 'end of the DNA sequence.
28. An adenovirus according to any of paragraphs 1 to 27, wherein at least one transgene cassette encodes monocistronic mRNA.
29. An adenovirus according to any one of paragraphs 1 to 28, wherein the bispecific T-cell activator has short half-life, for example 48 hours or less.
30. An adenovirus according to any one of paragraphs 1 to 29, wherein the bispecific T-cell activator is encoded in a region selected from E1, E3, $B_X$, $B_Y$ and combinations thereof.
31. An adenovirus according to paragraph 30, wherein the bispecific T-cell activator is encoded at least in position $B_X$, for example under the control of the major late promoter.
32. An adenovirus according to any one of paragraphs 1 to 29, wherein the adenovirus further encodes a second bispecific T-cell activator.
33. An adenovirus according to paragraph 32, wherein the first bispecific T-cell activator molecule is specific to a tumour antigen, for example a tumor antigen (for example as listed herein) and the second bispecific T-cell activator molecule is specific to a tumour stromal antigen, for example a stromal antigen (for example as listed herein).
34. An adenovirus according to any one of paragraphs 1 to 33, wherein the adenovirus further comprises a cytokine or chemokine or an immunomodulator (such as a cytokine or chemokine).
35. An adenovirus according to paragraph 34, wherein the cytokine or chemokine is selected from MIP1α, IL-1α, IL-1β, IL-6, IL-9, IL-12, IL-13, IL-17, IL-18, IL-22, IL-23, IL-24, IL-25, IL-26, IL-27, IL-33, IL-35, IL-2, IL-4, IL-5, IL-7, IL-18, IL-15, IL-21, IL-25, IL-1RA, IFNα, IFNβ, IFNγ, TNFα, lymphotoxin α (LTA), Flt3L, GM-CSF, IL-8, CCL2, CCL3, CCL5, CCL17, CCL20, CCL22, CXCL9, CXCL10, CXCL11, CXCL13, CXCL12, CCL2, CCL19, CCL21, (for example IL-1a, IL-1B, IL-6, IL-9, IL-12, IL-13, IL-17, IL-18, IL-22, IL-23, IL-24, IL-25, IL-26, IL-27, IL-33, IL-35, IL-2, IL-4, IL-5, IL-7, IL-10, IL-15, IL-21, IL-25, IL-1RA, IFNα, IFNβ, IFNγ, TNFα, lymphotoxin α (LTA), GM-CSF, IL-8, CCL2, CCL3, CCL5, CCL17, CCL20, CCL22, CXCL9, CXCL10, CXCL11, CXCL13, CXCL12, CCL2, CCL19, CCL21), such as IL-12, IL-18, IL-22, IL-7, IL-15, IL-21, IFNγ, TNFα, lymphotoxin α (LTA), CCL3, CCL5, CXCL9, CXCL10, CXCL12, CCL2, CCL19 and CCL21.
36. An adenovirus according to any one of paragraphs 1 to 35, wherein the adenovirus further comprises an immunomodulator, such as an antibody or antibody fragment, or protein or peptide ligand, specific to a checkpoint protein such as CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1 and PD-L2, or to a co-stimulatory molecule, such as CD28, CD80, CD86, CD83, ICOS, B7H2, TL1A and 4-1BB.
37. An adenovirus according to any one of the paragraphs 1 to 36, wherein the bispecific T-cell activator comprises a VH domain comprising an amino acid sequence as set forth in any one of SEQ ID NOs: 8, 13 or 18, or an amino acid sequence that is at least 95% identical thereto.
38. An adenovirus according to any one of paragraphs 1 to 37, wherein the bispecific T-cell activator comprises a VL domain comprising an amino acid sequence as set forth in any one of SEQ ID NOs: 9, 12 or 17, or an amino acid sequence that is at least 95% identical thereto.
39. An adenovirus according to any one of paragraphs 1 to 36, wherein the bispecific T-cell activator comprises a scFv comprising an amino acid sequence as set forth in any one of SEQ ID NOs: 7, 11 or 16, or an amino acid sequence that is at least 95% identical thereto.
40. An adenovirus according to any one of paragraphs 1 to 39, wherein the bispecific T-cell activator comprises an amino acid sequence set forth in SEQ ID NOs: 2 or 4, or an amino acid sequence that is at least 95% identical thereto, for example an amino acid sequence as set forth in SEQ ID NOs: 73 or 75.
41. An adenovirus according to any one of paragraphs 1 to 40, wherein the adenovirus comprises a DNA sequence set forth in any one of SEQ ID NOs: 34 to 37, or a DNA acid sequence that is at least 95% identical thereto, for example a DNA sequence as set forth in any one of SEQ ID NOs: 79 to 82.
42. A composition comprising an adenovirus according to any one of paragraphs 1 to 41 and a diluent or carrier.
43. A method of treating a patient comprising administering a therapeutically effective amount of an adenovirus of any one of paragraphs 1 to 41 or a composition of paragraph 42.
44. A method according to paragraph 43, for the treatment of cancer, in particular a solid tumour.

In one embodiment the adenovirus according to the present disclosure encodes at least one further transgene, for example 1, 2, 3 or 4 further transgenes.

In one embodiment a different cleavage peptide is encoded between each of the genes.

In one embodiment all the transgenes are in one location in the virus, for example the are in in position $B_Y$.

Advantageously, the present inventors have discovered that arming an adenovirus with a bispecific T-cell activator molecule allows the bi-specific antibody fragment molecule to 'piggyback' on the ability of the adenovirus to selectively infect cancer cells, thereby enabling the targeted delivery of the bispecific T-cell activator to tumour cells.

Advantageously, bispecific T-cell activators are small and can be made in mammalian cells. Hence once infected by the adenoviruses of the present disclosure, the bispecific T-cell activator molecules are synthesized by tumour cells, secreted and can act locally, spreading beyond the immediate footprint of the virus. This therefore allows the bispecific T-cell activator to spread beyond the immediate site of infection but at the same time limits the spread of the virus too far beyond the infected tumour cell nest. This minimises the risk of undesired off-target effects.

In one embodiment, the adenovirus is EnAd. EnAd has been shown to have an enhanced oncolytic activity compared to prior art adenoviruses. EnAd has also been shown to have a high selectivity for human epithelial-derived carcinoma cells, such as colon, lung, bladder and renal cancer cells. This makes it an ideal delivery vehicle for bispecific T-cell activator molecules because T-cells can be activated by the bispecific T-cell activator molecule to attack target cells whilst EnAd simultaneously infects and lyses cancer cells. This results in a two-pronged attack on the tumour which has a synergistic oncolytic effect.

In one embodiment the surface antigen is a component of the T-cell receptor complex (TCR), such as CD3, TCR-α and TCR-β.

In one embodiment the surface antigen is CD3 such as CD3ε, CD3γ and CD3δ, in particular CD3ε.

In one embodiment one of the binding domains is specific to a tumour antigen such as CEA, MUC-1, EpCAM, a HER receptor (such as HER1, HER2, HER3, HER4), PEM, A33, G250, carbohydrate antigens $Le^y$, $Le^x$, $Le^b$, PSMA, TAG-72, STEAP1, CD166, CD24, CD44, E-cadherin, SPARC, ErbB2 and ErbB3, in particular EpCAM.

In one embodiment one of the binding domains is specific to EpCAM, for example an EpCAM comprising an amino acid sequence as set forth in SEQ ID NO: 28 or a sequence at least 95% identical thereto.

In one embodiment at one of the binding domains is specific to a tumour stroma antigen, for example fibroblast activation protein (FAP), TREM1, IGFBP7, FSP-1, platelet-derived growth factor-α receptor (PDGFR-α), platelet-derived growth factor-β receptor (PDGFR-β) and vimentin. Advantageously, stromal cells (non-transformed cells) expressing these antigens are not subjected to the same level of mutation-resistance-selection process as transformed cells. Therefore, these cells are easier to target for cancer therapy since they are not a 'moving target'. Furthermore, the types of receptors found in stromal cells are often common across different types of cancer. Hence, targeting one of the above antigens is likely to be effective for multiple cancer types.

In one embodiment one of the binding domains is specific to FAP, for example a FAP comprising an amino acid sequence as set forth in SEQ ID NO: 30 or a sequence at least 95% indentical thereto. Advantageously, FAP is upregulated on tumour associated fibroblasts. Fibroblasts are a vital component of solid carcinomas supporting growth, invasion and recovery from interventions. They typically comprise 40-60% of the cells in advanced carcinomas. Advantageously, fibroblasts are genetically stable cells that are less likely to escape therapy than cancers cells. Activated fibroblasts are also relatively similar across a variety of tumour types. Thus, by activating T cells to target and kill FAP expressing tumour associated fibroblasts, the adenoviruses of the present disclosure can help to diminish a spectrum of immune suppressive pathways, such as those mediated by IL-10, TGFβ and ID0.

Other stromal targets, include tumor associated macrophages and myeloid derived suppressor cell antigen, for example CD163, CD206, CD68, CD11c, CD11b, CD14, CSF1 receptor, CD15, CD33, CD 66b and combinations of two or more of the same.

In one embodiment one of the binding domains in the bispecific T-cell activator is specific to a non-TCR activating protein such as CD31, CD2 and CD277.

In one embodiment one of the binding domains is specific to a surface antigen on a T cell of interest, such as selected from CD3 (such as CD3 delta, CD3 epsilon or CD3 gamma), TCR-α chain and TCR-β chain, and one binding domain is specific to a tumour antigen.

In one embodiment one of the binding domains is specific to CD3 and another binding domain is specific for a tumor antigen,f or example selected from the group consisting of: CEA, MUC-1, EpCAM, HER receptors HER1, HER2, HER3, HER4, PEM, A33, G250, carbohydrate antigens $Le^y$, $Le^x$, $Le^b$, PSMA, TAG-72, STEAP1, CD166, CD24, CD44, E-cadherin, SPARC, ErbB2 and ErbB3.

In one embodiment one of the binding domains is specific to CD3 (such as CD3 delta, CD3 epsilon or CD3 gamma) and another binding domain is specific to EpCAM.

In one embodiment one of the binding domains is specific to CD3ε and another binding domain is specific to EpCAM.

In one embodiment one of the binding domains is specific to a surface antigen on a T cell of interest, such as selected from CD3 (such as CD3 delta, CD3 epsilon or CD3 gamma), TCR-α and TCR-β, and another binding domain is specific to a tumour stromal antigen.

In one embodiment one of the binding domains is specific to CD3 (such as CD3 delta, CD3 epsilon or CD3 gamma) and another binding domain is specific to a tumour stromal antigen, for example selected from the group consisting of: fibroblast activation protein (FAP), TREM1, IGFBP7, FSP-1, platelet-derived growth factor-α receptor (PDGFR-α), platelet-derived growth factor-β receptor (PDGFR-β) and vimentin.

In one embodiment one of the binding domains is specific to CD3 (such as CD3 delta, CD3 epsilon or CD3 gamma) and another binding domain is specific to FAP.

In one embodiment one of the binding domains is specific to CD3ε and another binding domain is specific to FAP.

In one embodiment one of the binding domains is specific to a surface antigen on a T cell of interest, such as CD3, TCR-α and TCR-β and another binding domain is specific to a non-TCR activating protein.

In one embodiment one of the binding domains is specific to a CD3 (such as CD3 delta, CD3 epsilon or CD3 gamma) and another binding domain is specific to a non-TCR activating protein selected from the group consisting of CD31, CD2 and CD277.

In one embodiment one of the binding domains is specific to CD3ε and another binding domain is specific to non-TCR activating protein selected from the group consisting of CD31, CD2 and CD277.

In one embodiment at least one of $B_X$ or $B_Y$ is not a bond.

In one embodiment $B_X$ is not a bond.

In one embodiment $B_Y$ is not a bond.

In one embodiment both $B_X$ and $B_Y$ are not bonds.

In one embodiment the adenovirus is chimeric.

In one embodiment the adenovirus is oncolytic.

In one embodiment the adenovirus is chimeric and oncolytic.

In one embodiment the adenovirus replication capable.

In one embodiment the adenovirus is chimeric, oncolytic and replication capable.

In one embodiment the adenovirus is replication competent.

In another embodiment the adenovirus is chimeric, oncolytic and replication competent.

In one embodiment the adenovirus is replication deficient, i.e. is a vector.

In one embodiment $B_X$ comprises a transgene or transgene cassette, in particular a transgene cassette encoding a bispecific T-cell activator according to the the present disclosure.

In one embodiment $B_Y$ comprises a transgene or transgene cassette, in particular a transgene cassette encoding a bispecific T-cell activator according to the the present disclosure.

In one embodiment $B_Y$ comprises a transgene or transgene cassette, in particular a transgene cassette encoding a bispecific T-cell activator according to the the present disclosure and $B_X$ represents a bond.

In one embodiment both $B_X$ and $B_Y$ comprise a transgene or transgene cassette.

In one embodiment, the one or more transgenes or transgene cassettes is under the control of an endogenous or exogenous promoter, such as an endogenous promotor. Advantageously, when under the control of these promoters the virus remains replication competent and is also able to express the bispecific T-cell activator and/or other protein. Thus the bispecific T-cell activator of choice will be expressed by the cancer cell. Employing an exogenous promoter may be advantageous in some embodiments because it can strongly and constitutively express the antibody or fragment, which may be particularly useful in some situations, for example where the patient has very pervasive cancer. Employing an endogenous promoter may be advantageous because it reduces the size of the transgene cassette that needs to be incorporated to express the bispecific T-cell activator, i.e. the cassette can be smaller because no exogenous promoter needs to be included.

Accordingly, in one embodiment the transgene or transgene cassette is under the control of an endogenous promoter selected from the group consisting of E4 and major late promoter, in particular the major late promoter. Employing an endogenous promoter in the virus may also be advantageous in a therapeutic context because the transgene is only expressed when the virus is replicating in a cancer cell as opposed to a constitutive exogenous promoter which will continually transcribe the transgene and may lead to an inappropriate concentration of the antibody or fragment.

In one embodiment, the transgene or transgene cassette (for example encoding a bispecific T-cell activator) is under the control of an exogenous promoter, such as CMV. Advantageously, the use of a constitutive exogenous promoter results in continuous transcription of the transgene which may be desirable in certain instances.

In one embodiment one transgene or transgene cassette (for example encoding a bispecific T-cell activator) is under the control of an endogenous promoter and another transgene or transgene cassette (for example encoding a bispecific T-cell activator) is under the control of an exogenous promoter.

In one embodiment all of the transgenes or transgene cassettes (for example encoding a bispecific T-cell activator) in the virus is/are under the control of an endogenous promoter.

In another embodiment all of the transgenes or transgene cassettes (for example encoding a bispecific T-cell activator) in the virus is/are under the control of an exogenous promoter.

In one embodiment the transgene or transgene cassette further comprises a regulatory element independently selected from:
  i) a splice acceptor sequence,
  ii) an internal ribosome entry sequence or a high self-cleavage efficiency 2A peptide,
  iii) a Kozak sequence, and
  iv) combinations thereof.

Thus in one embodiment the transgene cassette comprises i) or ii) or iii) or iv).

In one embodiment the transgene cassette comprises i) and ii), or i) and iii), or i) and iv), or ii) and iii), or ii) and iv), or iii) and iv).

In one embodiment the transgene cassette comprises i) and ii) and iii), or i) and ii) and iv), or i) and iii) and iv), or ii) and iii) and iv).

In one embodiment, the transgene cassette comprises i) and ii) and iii) and iv).

In one embodiment, the transgene cassette comprises a Kozak sequence at the start of the protein (for example bispecific T-cell activator) coding sequence, which assists in the translation of mRNA.

In one embodiment, the transgene cassette encodes a high self-cleavage efficiency 2A peptide.

In one embodiment the transgene cassette further comprises a polyadenylation sequence.

In one embodiment the transgene cassette further comprises a restriction site at the 3'end of the DNA sequence and/or at the 5'end of the DNA sequence.

In one embodiment at least one transgene cassette encodes monocistronic mRNA.

In one embodiment the bispecific T-cell activator molecule has short half-life, for example 48 hours or less.

In one embodiment the bispecific T-cell activator molecule is encoded in a region selected from E1, E3, $B_X$, $B_Y$ and combinations thereof. Advantageously, the present inventors have established that a variety of transgenes can be inserted into $B_X$ and/or $B_Y$ under the control of an exogenous or endogenous promoter, without adversely affecting the life cycle of the virus or the stability of the vector.

In one embodiment, the bispecific T-cell activator molecule is encoded at least in position $B_X$, for example under the control of the major late promoter. Advantageously, the transgene or transgene cassette allows the Bispecific T-cell activator or any additional molecule to be expressed together with the adenovirus itself. Importantly, the present inventors successfully demonstrated that the expression of the bispecific T-cell activator did not significantly affect the ability of EnAd to replicate nor negatively impact its oncolytic activity.

In one embodiment, the bispecific T-cell activator molecule is encoded at least in position $B_Y$, for example under the control of the major late promoter. Advantageously, the transgene or transgene cassette allows the bispecific T-cell activators or any additional molecule to be expressed together with the adenovirus itself. Importantly, the present inventors successfully demonstrated that the expression of the bispecific T-cell activator did not significantly affect the ability of EnAd to replicate nor negatively impact its oncolytic activity.

In one embodiment, the adenovirus further encodes a second Bispecific T-cell activator.

In one embodiment, the first bispecific T-cell activator molecule is specific to a tumour antigen, for example a tumor antigen as described above, and the second bispecific T-cell activator molecule is specific to a tumour stromal antigen, for example a stromal antigen as described above.

In one embodiment the first bispecific T-cell activator molecule is specific to a tumour antigen selected from the group consisting of: CEA, MUC-1, EpCAM, HER receptors HER1, HER2, HER3, HER4, PEM, A33, G250, carbohydrate antigens $Le^y$, $Le^x$, $Le^b$, PSMA, TAG-72, STEAP1, CD166, CD24, CD44, E-cadherin, SPARC, ErbB2 and ErbB3 and the second bispecific T-cell activator molecule is specific to a tumour stromal antigen selected from the group consisting of: fibroblast activation protein (FAP), TREM1, IGFBP7, FSP-1, platelet-derived growth factor-α receptor (PDGFR-α), platelet-derived growth factor-β receptor (PDGFR-β) and vimentin.

In one embodiment the first bispecific T-cell activator molecule is specific to EpCAM and the second Bispecific T-cell activator molecule is specific to a tumour stromal antigen selected from the group consisting of: fibroblast activation protein (FAP), TREM1, IGFBP7, FSP-1, platelet-derived growth factor-α receptor (PDGFR-α), platelet-derived growth factor-β receptor (PDGFR-β) and vimentin.

In one embodiment the first bispecific T-cell activator molecule is specific to a tumour antigen selected from the group consisting of: CEA, MUC-1, EpCAM, HER receptors HER1, HER2, HER3, HER4, PEM, A33, G250, carbohydrate antigens Le$^y$, Le$^x$, Le$^b$, PSMA, TAG-72, STEAP1, CD166, CD24, CD44, E-cadherin, SPARC, ErbB2 and ErbB3 and the second bispecific T-cell activator is specific to FAP.

In one embodiment the first bispecific T-cell activator molecule s specific to EpCAM and the second bispecific T-cell activator molecule is specific to FAP.

In another embodiment the first bispecific T-cell activator molecule is specific to a tumour antigen and the second bispecific T-cell activator molecule is specific to a non-TCR activating protein.

In one embodiment the first bispecific T-cell activator molecule is specific to a tumor antigen selected from the group consisting of: CEA, MUC-1, EpCAM, HER receptors HER1, HER2, HER3, HER4, PEM, A33, G250, carbohydrate antigens Le$^y$, Le$^x$, Le$^b$, PSMA, TAG-72, STEAP1, CD166, CD24, CD44, E-cadherin, SPARC, ErbB2 and ErbB3.

In one embodiment the first bispecific T-cell activator molecule is specific to EpCAM and the second bispecific T-cell activator molecule is specific to a non-TCR activating protein selected from the group consisting of: CD31, CD2 and CD277.

In one embodiment the first bispecific T-cell activator molecule is specific to a tumour stromal antigen and the second bispecific T-cell activator molecule is specific to a non-TCR activating protein.

In one embodiment the first bispecific T-cell activator molecule is specific to a tumour stromal antigen selected from the group consisting of: fibroblast activation protein (FAP), TREM1, IGFBP7, FSP-1, platelet-derived growth factor-α receptor (PDGFR-α), platelet-derived growth factor-β receptor (PDGFR-β) and vimentin and the second bispecific T-cell activator molecule is specific to a non-TCR activating protein selected from the group consisting of: CD31, CD2 and CD277.

In one embodiment the first bispecific T-cell activator molecule is specific to FAP and the second bispecific T-cell activator molecule is specific to a non-TCR activating protein selected from the group consisting of: CD31, CD2 and CD277.

In one embodiment the adenovirus only comprises one bispecific T-cell activator.

In another embodiment the adenovirus comprises two bispecific T-cell activators.

In another embodiment the adenovirus comprises three bispecific T-cell activators.

In addition to encoding one two or three bispecific T-cell activators the virus may also encode a 1, 2, 3 or 4 further transgenes.

In one embodiment the adenovirus further encodes a cytokine or chemokine.

In one embodiment the adenovirus further encodes a cytokine.

In one embodiment the adenovirus further encodes a chemokine.

In another embodiment the adenovirus further encodes a cytokine and a chemokine.

In one embodiment the adenovirus comprises one bispecific T-cell activator and at least one cytokine or chemokine, for example 1, 2 or 3 cytokines, 1, 2 or 3 chemokines or a combination of 2 or 3 genes each gene independently encoding a cytokine of chemokine.

In another embodiment the adenovirus comprises two bispecific T-cell activators and at least one cytokine or chemokine for example 1 or 2 cytokines, 1 or 2 chemokines or a combination of a cytokine and a chemokine.

In another embodiment the adenovirus comprises three bispecific T-cell activators and at least one cytokine or chemokine.

In one embodiment the cytokine or chemokine is selected from IL-1α, IL-1β, IL-6, IL-9, IL-12, IL-13, IL-17, IL-18, IL-22, IL-23, IL-24, IL-25, IL-26, IL-27, IL-33, IL-35, IL-2, IL-4, IL-5, IL-7, IL-10, IL-15, IL-21, IL-25, IL-1RA, IFNα, IFNβ, IFNγ, TNFα, lymphotoxin α (LTA) and GM-CSF, IL-8, CCL2, CCL3, CCL5, CCL17, CCL20, CCL22, CXCL9, CXCL10, CXCL11, CXCL13, CXCL12, CCL2, CCL19, CCL21, for example IL-12, IL-18, IL-22, IL-7, IL-15, IL-21, IFNγ, TNFα, lymphotoxin α (LTA), CCL3, CCL5, CXCL9, CXCL12, CCL2, CCL19 and CCL21.

In one embodiment, the the encoded cytokine is selected from TNF alpha super family (TNFRSF includes TNF-alpha, TNF-C, OX40L, CD154, FasL, LIGHT, TL1A, CD70, Siva, CD153, 4-1BB ligand, TRAIL, RANKL, TWEAK, APRIL, BAFF, CAMLG, NGF, BDNF, NT-3, NT-4, GITR ligand, EDA-A, EDA-A2), TGF-beta superfamily, IL-1 family (i.e. IL-1 and IL-8), IL-2 family, IL-10 family, IL-17 family, interferon family.

In one embodiment the chemokine is selected from the group comprising MIP-1 alpha, RANTES, IL-8, CCL5, CCL17, CCL20, CCL22, CXCL9, CXCL10, CXCL11, CXCL13, CXCL12, CCL2, CCL19 and CCL21.

In one embodiment, the adenovirus further comprises an immunomodulator, such as an antibody or antibody fragment, or protein or peptide ligand, specific to a checkpoint protein or co-stimulatory molecule, or specific binding ligands for such molecules.

In one embodiment the immunomodulator is an antibody or antibody fragment, or protein or peptide ligand, specific to a checkpoint protein such as CTLA-4, PD-1, PD-L1, PD-L2, VISTA, B$_7$-H3, B$_7$-H4, HVEM, ILT-2, ILT-3, ILT-4, TIM-3, LAG-3, BTLA, LIGHT or CD160, for example CTLA-4, PD-1, PD-L1 and PD-L2.

In one embodiment the immunomodulator is an inhibitor, for example a checkpoint inhibitor.

In one embodiment the immunomodulator is an agonist.

In another embodiment the immunomodulator is an antibody or antibody fragment, or protein or peptide ligand, specific to a co-stimulatory molecule such as CD28, CD80, CD86, CD83, ICOS, B7H2, TL1A and 4-1BB.

In one embodiment the adenovirus comprises a first antibody, antibody fragment, protein or peptide ligand specific to a checkpoint protein and a second antibody, antibody fragment, protein or peptide ligand specific to a co-stimulatory molecule.

In one embodiment the bispecific T-cell activator comprises a VH domain comprising an amino acid sequence as set forth in any one of SEQ ID NOs: 8, 13 or 18, or an amino acid sequence that is at least 95% identical thereto.

In one embodiment the bispecific T-cell activator comprises a VL domain comprising an amino acid sequence as set forth in any one of SEQ ID NOs: 9, 12 or 17, or an amino acid sequence that is at least 95% identical thereto.

In one embodiment the bispecific T-cell activator comprises a scFv comprising an amino acid sequence as set forth in any one of SEQ ID NOs: 7, 11 or 16, or an amino acid sequence that is at least 95% identical thereto.

In one embodiment, a bispecific T-cell activator employed in the present disclosure (i.e encoded by the adenovirus) comprises a binding domain with a VH domain with a sequence shown in SEQ ID NO: 8 or a sequence at least 95% identical thereto, and a VL domain with a sequence shown in SEQ ID NO: 9 or a sequence at least 95% identical thereto.

In one embodiment, a bispecific T-cell activators employed in the present disclosure (i.e encoded by the adenovirus) comprises a binding domain with a VH domain with a sequence shown in SEQ ID NO: 13 or a sequence at least 95% identical thereto, and a VL domain with a sequence shown in SEQ ID NO: 12 or a sequence at least 95% identical thereto.

In one embodiment, a bispecific T-cell activator employed in the present disclosure (i.e encoded by the adenovirus) comprises a binding domain with a VH domain with a sequence shown in SEQ ID NO: 18 or a sequence at least 95% identical thereto, and a VL domain with a sequence shown in SEQ ID NO: 17 or a sequence at least 95% identical thereto.

In one embodiment, a bispecific T-cell activator employed in the present disclosure (i.e encoded by the adenovirus) comprises a binding domain with a VH domain with a sequence shown in SEQ ID NO: 8 or a sequence at least 95% identical thereto, and a VL domain with a sequence shown in SEQ ID NO: 9 or a sequence at least 95% identical thereto, and a binding domain with a VH domain with a sequence shown in SEQ ID NO: 13 or a sequence at least 95% identical thereto, and a VL domain with a sequence shown in SEQ ID NO: 12 or a sequence at least 95% identical thereto.

In one embodiment, a bispecific T-cell activator employed in the present disclosure (i.e encoded by the adenovirus) comprises a binding domain with a VH domain with a sequence shown in SEQ ID NO: 8 or a sequence at least 95% identical thereto, and a VL domain with a sequence shown in SEQ ID NO: 9 or a sequence at least 95% identical thereto, and a binding domain with a VH domain with a sequence shown in SEQ ID NO: 18 or a sequence at least 95% identical thereto, and a VL domain with a sequence shown in SEQ ID NO: 17 or a sequence at least 95% identical thereto.

In one embodiment, a bispecific T-cell activator employed in the present disclosure (i.e encoded by the adenovirus) comprises a sequence shown in SEQ ID NO: 7, 11, 16 or a sequence at least 95% identical to any one of the same.

In one embodiment, a bispecific T-cell activator employed in the present disclosure (i.e encoded by the adenovirus) comprises a sequence shown in SEQ ID NO: 7 or a sequence at least 95% identical thereto.

In one embodiment, a bispecific T-cell activator employed in the present disclosure (i.e encoded by the adenovirus) comprises a sequence shown in SEQ ID NO: 11 or a sequence at least 95% identical thereto.

In one embodiment, a bispecific T-cell activator employed in the present disclosure (i.e encoded by the adenovirus) comprises a sequence shown in SEQ ID NO: 16 or a sequence at least 95% identical thereto.

In one embodiment the bispecific T-cell activator comprises an amino acid sequence set forth in SEQ ID NOs: 2 or 4, or an amino acid sequence that is at least 95% identical thereto, for example an amino acid as set forth in SEQ ID NOs: 73 or 75.

In one embodiment the adenovirus according to the present disclosure comprises a DNA sequence set forth in any one of SEQ ID NOs: 34 to 37, or a DNA acid sequence that that hybridises thereto under stringent conditions.

In one embodiment the adenovirus according to the present disclosure comprises a DNA sequence set forth in any one of SEQ ID NOs: SEQ ID NOs: 79 to 82.

In one embodiment the adenovirus according to the present disclosure comprises a DNA sequence shown in any one of SEQ ID NO: 34, 35, 36, 37, 79, 80, 82, 96, 97, 98, 99, 100, 101, 102, 103, 120, 298 or a sequence encoding the same virus, or a sequence that hybrises to the any one of the same under stringent conditions.

In one embodiment the adenovirus according to the present disclosure comprises a DNA sequence shown in any one of SEQ ID NO: 34, 35, 36, 37, 79, 80, 82, 96, 97, 98, 99, 100, 101, 102, 103, 120 or 298.

The skilled person is aware that there is reduncy in the DNA code, thus the present disclosure extends to EnAd or Ad11 encoding a bispecific T-cell activator with an amino acid disclosed herein.

The C-terminal deca-His (HHHHHHHHHH SEQ ID NO: 24) affinity tag is useful for purification of the bispecific T-cell activator or adenovirus. However, it is optional and may be excluded for example in the end product. The skilled person would also be aware that other affinity tags other than deca-His can be used and likewise may be excluded without affecting the biological function of the bispecific T-cell activator or adenovirus. Accordingly, in one embodiment the bispecific T-cell activator comprises an amino acid sequence as set forth in any one of SEQ ID NOs: 2 or 4 but excludes the deca-His affinity tag at the C-terminal end of the sequence, for example as set forth in SEQ ID NOs: 73 or 75. In another embodiment, the adenovirus comprises a DNA sequence set forth in any one of SEQ ID NOs: 34 to 37 but excludes the deca-His affinity tag, for example a DNA sequence as set forth in any one of SEQ ID NOs: 79 to 82.

The exclusion of the deca-His affinity tag further extends to all other sequences disclosed herein comprising the deca-His affinity tag, i.e. the present disclosure includes the same amino acid or DNA sequences lacking the C-terminal deca-His tag (HHHHHHHHHH or CATCACCATCACCAT-CACCACCATCACCAT), for example as set forth in any one of SEQ ID NOs: 72 to 82.

In one embodiment the bispecific T-cell activator encoded by the virus of the present disclosure is under the control of an exogenous promoter, for example the CMV promoter. The exogenonus may be placed between the MPL and the encoded transgene when the transgene is between L5 and E4 regions.

The exogenonus may be placed between the encoded transgene and L5 when the transgene is between L5 and E3 regions.

In one aspect there is provided a composition comprising an adenovirus as described herein and a diluent or carrier.

In one aspect, there is provided a method of treating a patient comprising administering a therapeutically effective amount of an adenovirus or a composition as described herein.

In one embodiment the method is for the treatment of cancer, for example an epithelial cancer, in particular a solid tumour.

In one embodiment there is provide a method of treatment comprising administering a virus according to the present disclosure in combination with a checkpoint inhibitor (such as a PD-1 or PDL1 inhibitor), in particular wherein the checkpoint inhibitor is encoding in the virus.

In one embodiment there is provide a method of treatment comprising administering a virus according to the present disclosure which is NOT in combination with a checkpoint inhibitor (for example as listed elsewhere herein such as a PD-1 or PDL1 inhibitor), in particular wherein the checkpoint inhibitor is not encoding in the virus.

The bispecific T-cell activators encoded by the virus as per the present disclosure have the ability to potentiate the cytotoxicity of the virus.

Surprisingly the bispecific T-cell activators encoded by a virus as per the present disclosure can activate CD4+ cells and/or CD8+ cells, for example even cells in the suppressive environment of the tumor, including T cells in the fluid environment, such as ascites, of the tumor.

Advantageously the bispecific T-cell activators encoded by a virus as per the present disclosure can activate cytotoxic T cells, for example even T cells in the suppressive environment of the tumor, including T cells in the fluid environment, such as ascites, of the tumor.

Even more surprisingly the bispecific T-cell activators encoded by a virus as per the present disclosure are capable of stimulating (activating) T cell proliferation.

The viruses encoding bispecific T-cell activators according to the present disclosure seem to be able to by-pass, overcome or reverse the immune suppressive microenvironment of the tumor.

In one embodiment the activation of T cells results in upregulation of a T cell marker, for example CD25.

In one embodiment a binding of a bispecific T-cell activator in a virus according to the present disclosure is specific to a neoantigen.

The disclosure also extends to novel sequences, disclosed herein.

DETAILED DESCRIPTION

Immune cell as employed herein is a cell with a funcational role in the immune system, including (but not limited to), macrophages, neutrophils, dendritic cells, NK cells, lymphocytes, such as T lymphocytes (in particular T cells and NKT cells).

The term antibody as used herein refers to an immunoglobulin molecule capable of specific binding to a target antigen, such as a carbohydrate, polynucleotide, lipid, polypeptide, peptide etc., via at least one antigen recognition site (also referred to as a binding site herein), located in the variable region of the immunoglobulin molecule. Unless the context indicates otherwise the term extends to full length antibodies and multi-specific antibody molecules comprising full length antibodies.

As used herein "antibody molecule" includes antibodies and binding fragments thereof and multi-specific formats of any one of the same.

Antigen binding site as employed herein refers to a portion of the molecule, which comprises a pair of variable regions, in particular a cognate pair that interact specifically with the target antigen.

Specifically, as employed herein, is intended to refer to a binding site that only recognises the antigen to which it is specific or a binding site that has significantly higher binding affinity to the antigen to which is specific compared to affinity to antigens to which it is non-specific, for example 5, 6, 7, 8, 9, 10 times higher binding affinity.

Binding fragments or antibody binding fragments as employed herein refer to antibody binding fragments and multi-specific antibody molecules comprising antibody binding fragments including but not limited to Fab, modified Fab, Fab', modified Fab', F(ab')$_2$, Fv, single domain antibodies, scFv, bi, tri or tetra-valent antibodies, Bis-scFv, diabodies, triabodies, tetrabodies and epitope-binding fragments of any of the above (see for example Holliger and Hudson, 2005, Nature Biotech. 23(9):1126-1136; Adair and Lawson, 2005, Drug Design Reviews—Online 2(3), 209-217). The methods for creating and manufacturing these antibody fragments are well known in the art (see for example Verma et al., 1998, Journal of Immunological Methods, 216:165-181). Other antibody fragments for use in the present disclosure include the Fab and Fab' fragments described in International patent applications WO05/003169, WO05/003170 and WO05/003171. Multi-valent antibodies may comprise multiple specificities e.g. bispecific or may be monospecific (see for example WO92/22853 and WO05/113605).

In one embodiment the adenovirus comprises a multi-specific antibody molecule.

Multi-specific antibody molecule as employed herein refers to an antibody molecule which has two or more antigen binding domains, for example two (bispecific) or three (tri-specific) or four (tetra-specific) binding domains.

Multi-specific antibody molecules of the present disclosure may be constructed from various antibody fragments such as those described above. For example a diabody is a bispecific antibody molecule composed of a non-covalent dimer of ScFv fragments, whilst a F(ab')$_2$ is a bispecific antibody molecule composed of 2 Fab fragments linked by a hinge region. The skilled person will therefore be aware that different antibody fragments can be arranged in various combinations in order to produce a bi- or multi-specific antibody molecule.

Examples of tri-specific or tetra-specific antibody formats include but are not limited to Fab 3, triabody, tetrabody, tribody, DVD-Ig, IgG-scFv, ScFv 2-Fc, tandAbs and DNL-Fab3.

Bi-specific antibody molecule as employed herein refers to a molecule with two antigen binding domains, which may bind the same or different antigens. A bispecific T-cell activator is a subclass of bispecific antibody molecules.

The domains may bind different antigens.

Alternatively, the domains may all bind the same antigen, including binding the same epitope on the antigen or binding different epitopes on the same antigen.

Examples of bispecific antibody formats include but are not limited to bispecific T cell activator, F(ab')$_2$, F(ab')-ScFv2, di-scFv, diabody, minibody, scFv-Fc, DART, TandAb, ScDiabody, ScDiabody-CH3, Diabody-CH3, triple body, miniantibody, minibody, TriBi minibody, ScFv-CH3 KIH (knobs in holes), Fab-ScFv, SCFv-CH-CL-scFv, scFv-KIH, Fab-scFv-Fc, Tetravalent HCAb, scDiabody-Fc, Diabody-Fc, intrabody, dock and lock antibodies, ImmTAC, HSAbody, ScDiabody-HAS, humabody and Tandem ScFv-toxic (see for example Christoph Spiess et al, Molecular Immunology 67 (2015) page 95-106).

The adenovirus of the present disclosure comprises a bispecific T-cell activator which is specific for at least a surface antigen on a T cell of interest Examples of T cell surface antigens include but are not limited to: CD3, CD2, VLA-1, CD8, CD4, CCR6, CXCR5, CD25, CD31, CD45RO, CD197, CD127, CD3δ, CD27, CD196, CD277 and CXCR3, particularly CD2, CD3, CD31 and CD277.

Bispecific T cell activator as used herein refers to a class of artificial bispecific monoclonal antibodies comprising 2 scFvs of different antibodies or amino acid sequences from 4 different genes on a single peptide chain of about 55 KDa. One of the scFvs is specific for an immune cell, such as a T cell antigen, such as the CD3 receptor, expressed on the surface of T cells. The other scFv typically binds to a tumour cell via a tumour-specific molecule. Accordingly, bispecific T-cell activators are able to form a link between T cells and tumour cells by virtue of their specificities for an antigen on the T cell and an antigen on the tumour cell. This leads to activation of the T-cells and triggers the T cells to exert their cytotoxic effects on tumour cells, independently of MHC I or co-stimulatory molecules. Examples of bispecific T-cell activator based therapies currently approved or undergoing clinical trials include for example Blinatumomab (Blyncyto®) which targets CD19 and is for the treatment of non-Hodkin's lymphoma and acute lymphoblastic leukemia and Solitomab which targets EpCAM and is for treating gastrointestinal and lung cancers.

In one embodiment the immune cell engager (such as T cell activator) is arranged is the format VL1-linker1-VH1-linker1-VH2-linker3-VL2, for example employing linkers independently selected from linker sequences disclosed herein, for example.

In one embodiment linkers in a bispecific T-cell activator, according to the present disclosure, are independently selected from SEQ ID NO: 10, 14, 23, 124 to 162 and 166 to 297.

In one embodiment linker1 and linker3 have the same sequence, for example a sequence shown in any one of SEQ ID NOs: 10, 14, 23, 124 to 162 and 166 to 296, in particular 10, 14 and 23.

In one embodiment linker1 and linker3 have different amino acid sequence, for example independently selected from SEQ ID NOs: 10, 14, 23, 124 to 162 and 166 to 296, in particular 10, 14 and 23.

In one embodiment Linker1 is SEQ ID NO: 10.
In one embodiment Linker1 is SEQ ID NO: 14.
In one embodiment Linker3 is SEQ ID NO: 10.
In one embodiment Linker3 is SEQ ID NO: 14.
In one embodiment Linker1 and Linker3 are SEQ ID NO: 10.
In one embodiment Linker1 and Linker3 are SEQ ID NO: 14.
In one embodiment Linker1 is SEQ ID NO: 10 and Linker 3 is SEQ ID NO: 14.
In one embodiment Linker1 is SEQ ID NO: 14 and Linker3 is SEQ ID NO: 10.
In one embodiment Linker1 is different to both Linker 1 and Linker3.

In one embodiment Linker 2 is selected from any one of SEQ ID NOs: 10, 14, 23, 124 to 162 and 166 to 297, such as SEQ ID NO: 297.

In one embodiment Linker1 is in the range 10 to 30 amino acids in length, such as 10, 11, 12, 13, 14, 15, 16, 17, 18, 19, 20, 21, 22, 23, 24, 25, 26, 27, 28, 29 or 30.

In one embodiment Linker3 is in the range 10 and 30 amino acids in length, such as 10, 11, 12, 13, 14, 15, 16, 17, 18, 19, 20, 21, 22, 23, 24, 25, 26, 27, 28, 29 or 30.

In one embodiment Linker 2 is in the range 2 to 10 amino acids in length, such as 2, 3, 4, 5, 6, 7, 8, 9 or 10.

In one embodiment VH1 & VL1 are specific to a T cell antigen according to the present disclosure, such as CD3.

In one embodiment VH2 &VL2 are specific to an immune cell antigen, such as a T cell antigen, according to the present disclosure, such as CD3.

In one embodiment VH1 & VL1 are specific to an antigen or interest, such as a cancer antigen or stromal antigen, etc.

In one embodiment VH2 & VL2 are specific to an antigen or interest, such as a cancer antigen or stromal antigen, etc.

Stroma or stromal antigen as employed herein refers to an antigen therapeutic target in the stroma, including expressed in the molecular structure of the stroma matrix, such as connective tissue molecules or molecules associated with this matrix or antigens associated with the cellular components of the stroma, for example expressed on fibroblasts, tumour-associated macrophages, dendritic cells, NK cells and/or T-cells which have infiltrated the stroma. Examples of stroma antigens include but are not limited to FAP, TGFβ, TREM1, IGFBP7, FSP-1, fibroblast associated antigen, NG2, endosialin (CD248), platelet-derived growth factor-α receptor (PDGFR-α), platelet-derived growth factor-β receptor (PDGFR-β) and vimentin.

Fibroblasts may be targeted by employing the antigen fibroblast activation protein (FAP), in particular an antibody specific to FAP which does not bind CD26, (see US2012/0258119 incorporated herein by reference).

FAP was originally identified as a serine protease on reactive stromal fibroblasts. Subsequent molecular cloning revealed that FAP is identical to seprase, a 170 kDa membrane associated gelatinase that is expressed by melanoma cell lines. Full length cDNA encoded a type H transmembrane protease of 760 amino acids (aa) highly homologous to dipeptidyl peptidase IV (DPPIV) with a 52% aa identity over the entire sequence and almost 70% identity in the catalytic domain. U.S. Pat. No. 5,587,299, incorporated herein by reference, describes nucleic acid molecules encoding FAP and applications thereof.

FAP and DPPIV have similar gene sizes and are chromosomally adjacent to each other at 2q24, suggesting a gene duplication event (Genebank accession number U09278). Both proteins are members of the prolyl peptidase family. This class of enzymes is inducible, active on the cell surface or in extracellular fluids, and uniquely capable of cleaving N-terminal dipeptides from polypeptides with proline or alanine in the penultimate position. DPPIV, also termed CD26, is constitutively expressed by several cell types including fibroblasts, endothelial and epithelial cells, leukocyte subsets like NK-cells, T-lymphocytes and macrophages. A small proportion of DPPIV circulates as soluble protein in the blood. In contrast to DPPIV, FAP is typically not expressed in normal adult tissue and its proteolytically active soluble form is termed a2-Antiplasmin Cleaving Enzyme (APCE). Marked FAP expression occurs in conditions associated with activated stroma, including wound healing, epithelial cancers, osteoarthritis, rheumatoid arthritis, cirrhosis and pulmonary fibrosis.

The FAP structure has been solved (PDB ID 1Z68) and is very similar to that of DPPIV. FAP is anchored in the plasma membrane by an uncleaved signal sequence of approximately 20 amino acids and has a short, amino terminal, cytoplasmic domain of six amino acids. The major part of the protein, including the catalytic domain, is exposed to the extracellular environment. The FAP glycoprotein is a homodimer consisting of two identical 97-kDa subunits. Each FAP-monomer subunit consists of two domains, an αβ hydrolase domain (aa 27-53 and 493-760) and an eight-blade β propeller domain (aa 54-492) that enclose a large cavity. A small pocket within this cavity at the interface of both domains contains the catalytic triad (Ser624, Asp702 and His734). FAP gains its enzymatic activity upon homodimerization of the subunits and beside its dipeptidyl peptidase activity, FAP also has collagen type I specific gelatinase and endopeptidase activity. The β propeller acts as scaffolding for protein-protein interactions and determines substrate and extracellular matrix (ECM) binding. Furthermore, the β propeller is involved in forming supra-molecular complexes of FAP with other prolyl peptidases or with other membrane-bound molecules. The formation of heteromeric or tetrameric complexes of FAP and DPPIV were found to be associated with invadopodia of migrating cells on a collagen substrate. Type I collagen induces a close association of FAP with β1 integrins, thereby playing major organizational roles in the formation and adhesion of invadopodia. Although the involved mechanisms are not understood in detail, the formation of such proteinase-rich membrane domains at the cellular invasion front contributes to directed pericellular ECM degradation. This indicates that FAP and ECM interactions may be closely related to invasive cell behaviour by influencing cell adhesion, migration, proliferation and apoptosis through integrin pathways and supports o role of FAP in disease pathogenesis and progression. In summary, FAP is recognized as a multifunctional protein that executes its biological functions in a cell dependent manner through a combination of its protease activity and its ability to form complexes with other cell-surface molecules. Over-expression of FAP in epithelial and fibroblastic cell lines promotes malignant behaviour, pointing to the clinical situation, where cellular expression levels of FAP are correlated with worse clinical outcome.

Through paracrine signaling molecules, cancer cells activate stromal fibroblasts and induce the expression of FAP, which in turn, affects the proliferation, invasion and migration of the cancer cells. Recent studies have demonstrated that TGF-β is the dominant factor in promoting FAP protein expression (Chen, H et al (2009) Exp and Molec Pathology, doi: 10.1016/j.yexmp. 2009.09.001). FAP is heavily expressed on reactive stromal fibroblasts in 90% of human epithelial carcinomas, including those of the breast, lung, colorectum and ovary (Garin-Chesa, P et al (1990) PNAS USA 87: 7236-7239). Chen et al have recently shown that FAPα influences the invasion, proliferation and migration of HO-8910PM ovarian cancer cells (Chen, H et al (2009) Exp and Molec Pathology, doi: 10.1016/j.yexmp. 2009.09.001).

FAP may be targeted by binding said antigen and sterically blocking its interaction with biologically relevant molecules. Alternatively, or additionally cross-linking the FAP molecule with another FAP molecule or a different molecule, for example an antigen on the surface of a cancer cell may be achieved employing a multispecific, such as a bispecific antibody molecule. This cross linking raised the visibility of the cells bearing the antigens to the immune systems, which then may be activated to neutral or destroy the same.

Tumour associated macrophages (TAMs) are thought to express TREM1, CD204, CD68 (alone or in combination with CD163 or CD206). These markers can be used to target the TAMs.

The adenovirus of the present disclosure has the ability to infect tumour cells, and in particular is chosen to preferentially infect tumour, cells. The oncolytic virus infection causes death and lysis of the cancer cell with release of newly generated virus particles. Incorporated transgenes encoding antibodies, bispecific T-cell activators and other "payloads" are newly synthesized and actively secreted by the tumor cells prior to their death, and some molecules will also be released upon cell lysis.

Antibody molecules with a short half-life may be particularly suitable for use in the present disclosure because this minimises off-target effects because the body rapidly clears the molecules if they become systemically available.

NKT cells have the ability to target and destroy tumour associated macrophages. However, their activity seems to be inhibited by the hypoxic environment of the tumour. This activity can be restored by providing the NKT cells with IL-2 and/or IL-15, for example encoded in the virus of the present disclosure.

Thus, in one embodiment the virus according to the present disclosure further encodes a cytokine to activate and NKT cells, for example selected from IL-2, IL-15 and combinations thereof. The gene encoding the cytokine may be in the same location or a different location to the gene encoding the antibody molecule, for example independently selected from E1, E3, E4, $B_X$ and $B_Y$.

Thus, the adenovirus according to the present disclosure has at least two or three mechanisms for attacking the tumour, including indirect mechanisms which undermine the tumour stroma.

Transgene as employed herein refers to a gene that has been inserted into the genome sequence, which is a gene that is unnatural to the virus (exogenous) or not normally found in that particular location in the virus. Examples of transgenes are given below. Transgene as employed herein also includes a functional fragment of the gene that is a portion of the gene which when inserted is suitable to perform the function or most of the function of the full-length gene.

Transgene and coding sequence are used interchangeably herein in the context of inserts into the viral genome, unless the context indicates otherwise. Coding sequence as employed herein means, for example a DNA sequence encoding a functional RNA, peptide, polypeptide or protein. Typically, the coding sequence is cDNA for the transgene that encodes the functional RNA, peptide, polypeptide or protein of interest. Functional RNA, peptides, polypeptide and proteins of interest are described below.

Clearly the virus genome contains coding sequences of DNA. Endogenous (naturally occurring genes) in the genomic sequence of the virus are not considered a transgene, within the context of the present specification unless then have been modified by recombinant techniques such as that they are in a non-natural location or in a non-natural environment.

In one embodiment transgene, as employed herein refers to a segment of DNA containing a gene or cDNA sequence that has been isolated from one organism and is introduced into a different organism i.e. the virus of the present disclosure. In one embodiment, this non-native segment of DNA may retain the ability to produce functional RNA, peptide, polypeptide or protein.

Thus, in one embodiment the transgene inserted encodes a human or humanised protein, polypeptide or peptide.

In one embodiment, the transgene inserted encodes a non-human protein, polypeptide or peptide (such as a non-human mammalian protein, polypeptide or peptide) or RNA molecule, for example from a mouse, rat, rabbit, camel, llama or similar. Advantageously, the viruses of the present disclosure allow the transgenes to be transported inside the cancerous cell. Thus, responses generated by the human patient to a non-human sequence (such as a protein) can be minimised by this intra-cellular delivery.

A DNA sequence may comprise more than one transgene, for example, 1, 2, 3 or 4 transgenes, such as 1 or 2.

A transgene cassette may comprise more than one transgene, for example, 1, 2, 3 or 4 transgenes, such as 1 or 2.

In one or more embodiments, the cassette is arranged as shown in the one or more of the Figures or the examples.

Transgene cassette as employed herein refers to a DNA sequence encoding one or more transgenes in the form of one or more coding sequences and one or more regulatory elements.

A transgene cassette may encode one or more monocistronic and/or polycistronic mRNA sequences.

In one embodiment, the transgene or transgene cassette encodes a monocistronic or polycistronic mRNA, and for example the cassette is suitable for insertion into the adenovirus genome at a location under the control of an endogenous promoter or exogenous promoter or a combination thereof.

Monocistronic mRNA as employed herein refers to an mRNA molecule encoding a single functional RNA, peptide, polypeptide or protein.

In one embodiment, the transgene cassette encodes monocistronic mRNA.

In one embodiment the transgene cassette in the context of a cassette encoding monocistronic mRNA means a segment of DNA optionally containing an exogenous promoter (which is a regulatory sequence that will determine where and when the transgene is active) or a splice site (which is a regulatory sequence determining when a mRNA molecule will be cleaved by the spliceosome) a coding sequence (i.e. the transgene), usually derived from the cDNA for the protein of interest, optionally containing a polyA signal sequence and a terminator sequence.

In one embodiment, the transgene cassette may encode one or more polycistronic mRNA sequences.

Polycistronic mRNA as employed herein refers to an mRNA molecule encoding two or more functional RNA, peptides or proteins or a combination thereof. In one embodiment the transgene cassette encodes a polycistronic mRNA.

In one embodiment transgene cassette in the context of a cassette encoding polycistronic mRNA includes a segment of DNA optionally containing an exogenous promoter (which is a regulatory sequence that will determine where and when the transgene is active) or a splice site (which is a regulatory sequence determining when a mRNA molecule will be cleaved by the spliceosome) two or more coding sequences (i.e. the transgenes), usually derived from the cDNA for the protein or peptide of interest, for example wherein each coding sequence is separated by either an IRES or a 2A peptide. Following the last coding sequence to be transcribed, the cassette may optionally contain a polyA sequence and a terminator sequence.

In one embodiment, the transgene cassette encodes a monocistronic mRNA followed by a polycistronic mRNA. In another embodiment the transgene cassette a polycistronic mRNA followed by a monocistronic mRNA.

In one embodiment, the adenovirus is a human adenovirus. "Adenovirus", "serotype" or adenoviral serotype" as employed herein refers to any adenovirus that can be assigned to any of the over 50 currently known adenoviral serotypes, which are classified into subgroups A-F, and further extends to any, as yet, unidentified or unclassified adenoviral serotypes. See, for example, Strauss, "Adenovirus infections in humans," in The Adenoviruses, Ginsberg, ea., Plenum Press, New York, NY, pp. 451-596 (1984) and Shenk, "Adenoviridae: The Viruses and Their Replication," in Fields Virology, Vol. 2, Fourth Edition, Knipe, 35ea., Lippincott Williams & Wilkins, pp. 2265-2267 (2001), as shown in Table 1.

TABLE 1

| SubGroup | Adenoviral Serotype |
| --- | --- |
| A | 12, 18, 31 |
| B | 3, 7, 11, 14, 16, 21, 34, 35, 51 |
| C | 1, 2, 5, 6 |
| D | 8-10, 13, 15, 17, 19, 20, 22-30, 32, 33, 36-39, 42-49, 50 |
| E | 4 |
| F | 40, 41 |

The adenoviruses of the present disclosure are subgroup B virues, namely, Ad11, in particular Ad11p (the Slobitski strain) and derivatives thereof, such as EnAd.

Adenoviruses are designated to their groups/serotypes based on the capsid, such as the hexon and/or fibre The adenovirus of the present disclosure is not a group A, C, D, E or F virus. The viruses of the present disclosure do not comprise an adenovirus death protein.

In one embodiment, the adenovirus of the present disclosure is chimeric. When an adenovirus is chimeric then the characteristics of the outer capsid will be employed to determine the serotype. Chimeric as employed herein refers to a virus that comprises DNA from at least two different virus serotypes, including different serotypes within the same group.

In one embodiment, the oncolytic virus has a fibre, hexon and penton proteins from the same serotype, for example Ad11, in particular Ad11p, for example found at positions 30812-31789, 18254-21100 and 13682-15367 of the genomic sequence of the latter wherein the nucleotide positions are relative to genbank ID 217307399 (accession number: GC689208).

In one embodiment, the adenovirus is enadenotucirev (also known as EnAd and formerly as EnAd). Enadenotucirev as employed herein refers the chimeric adenovirus of SEQ ID NO: 38. It is a replication competent oncolytic chimeric adenovirus which has enhanced therapeutic properties compared to wild type adenoviruses (see WO2005/118825). EnAd has a chimeric E2B region, which features DNA from Ad11p and Ad3, and deletions in E3/E4. The structural changes in enadenotucirev result in a genome that is approximately 3.5 kb smaller than Ad11p thereby providing additional "space" for the insertion of transgenes.

Enadenotucirev (EnAd) is a chimeric oncolytic adenovirus, formerly known as EnAd (WO2005/118825), with fibre, penton and hexon from Ad11p, hence it is a subgroup B virus. It has a chimeric E2B region, which comprises DNA from Ad11p and Ad3. Almost all of the E3 region and part of the E4 region is deleted in EnAd. Therefore, it has significant space in the genome to accommodate additional genetic material whilst remaining viable. Furthermore, because EnAd is a subgroup B adenovirus, pre-existing immunity in humans is less common than, for example, Ad5. Other examples of chimeric oncolytic viruses with Ad11 fibre, penton and hexon include OvAd1 and OvAd2 (see WO2006/060314).

EnAd seems to preferentially infect tumour cells, replicates rapidly in these cells and causes cell lysis. This, in turn, can generate inflammatory immune responses thereby stimulating the body to also fight the cancer. Part of the success of EnAd is hypothesised to be related to the fast replication of the virus in vivo.

Whilst EnAd selectively lyses tumour cells, it may be possible to introduce further beneficial properties, for example increasing the therapeutic activity of the virus or reducing side-effects of the virus by arming it with transgenes, such as a transgene which encodes a cell signalling protein or an antibody, or a transgene which encodes an entity which stimulates a cell signalling protein(s).

Advantageously arming a virus, with DNA encoding certain proteins, such as a bispecific T-cell activator, that can be expressed inside the cancer cell, may enable the body's own defences to be employed to combat tumour cells more effectively, for example by making the cells more visible to the immune system or by delivering a therapeutic gene/protein preferentially to target tumour cells.

Furthermore, the ability to insert transgenes that are reporters into the genome can aid clinical or pre-clinical studies.

It is important that expression of the transgenes does not adversely affect the replication or other advantageous properties of the virus. Thus, the gene or genes must be inserted in a location that does not compromise the replication competence and other advantageous properties of the virus. In addition, the genome of adenoviruses is tightly packed and therefore it can be difficult to find a suitable location to insert transgenes. This also limits the size of transgenes that can be accommodated.

OvAd1 and OvAd2 are also chimeric adenoviruses similar to enadenotucirev, which also have additional "space" in the genome (see WO2008/080003). Thus in one embodiment the adenovirus is OvAd1 or OvAd2.

In one embodiment, the adenovirus is oncolytic. Oncolytic adenovirus as employed herein means an adenovirus that preferentially kills cancer cells as compared with non-cancer cells.

In one embodiment, the oncolytic virus is apoptotic. That is, it hastens programmed cell death.

In one embodiment, the oncolytic virus is cytolytic. The cytolytic activity of oncolytic adenoviruses of the disclosure can be determined in representative tumour cell lines and the data converted to a measurement of potency, for example with an adenovirus belonging to subgroup C, such as Ad5, being used as a standard (i.e. given a potency of 1). A suitable method for determining cytolytic activity is an MTS assay (see Example 4, FIG. 2 of WO2005/118825 incorporated herein by reference).

In one embodiment the oncolytic virus is necrolytic. That is, it causes or hastens cell necrosis or immunogenic cell death. In one embodiment necrolytic cell death is advantageous because it triggers, induces the patients (host) immune responses.

Unless the context indicates otherwise, adenovirus as employed herein refers to a replication capable virus (such as a replication competent virus) and also replication deficient viral vectors.

Replication capable as employed herein refers to a replication competent virus or a virus whose replication is dependent on a factor in the cancer cells, for example an upregulated factor, such as p53 or similar.

In one embodiment the virus is replication competent. Replication competent in the context of the present specification refers to a virus that possesses all the necessary machinery to replicate in cells in vitro and in vivo, i.e. without the assistance of a packaging cell line. A viral vector, for example deleted in the E1 region, capable of replicating in a complementary packaging cell line is not a replication competent virus in the present context Viral vectors are replication deficient and require a packaging cell to provide a complementary gene to allow replication.

Adenovirus genome as employed herein means the DNA sequence encoding the structural proteins and elements relevant to the function/life cycle of an adenovirus.

All human adenovirus genomes examined to date have the same general organisation i.e., the genes encoding specific functions are located at the same position in the viral genome (referred to herein as structural elements). Each end of the viral genome has a short sequence known as the inverted terminal repeat (or ITR), which is required for viral replication. The viral genome contains five early transcription units (E1A, E1B, E2, E3, and E4), three delayed early units (IX, IVa2 and E2 late) and one late unit (major late) that is processed to generate five families of late mRNAs (L1-L5). Proteins encoded by the early genes are primarily involved in replication and modulation of the host cell response to infection, whereas the late genes encode viral structural proteins. Early genes are prefixed by the letter E and the late genes are prefixed by the letter L.

The genome of adenoviruses is tightly packed, that is, there is little non-coding sequence, and therefore it can be difficult to find a suitable location to insert transgenes. The present inventors have identified two DNA regions where transgenes are tolerated, in particular the sites identified are suitable for accommodating complicated transgenes, such as those encoding antibodies. That is, the transgene is expressed without adversely affecting the virus' viability, native properties such as oncolytic properties or replication.

In one embodiment the oncolytic or partial oncolytic virus according to the disclosure may be as a result of deletion in the E4 and/or E3 region, for example deleted in part of the E4 region or fully deleted in the E3 region, or alternatively deleted in part of the E4 region (such as E4orf4) and fully deleted in the E3 region, for example as exemplified in the sequences disclosed herein.

In one embodiment the oncolytic virus of the disclosure is chimeric. Chimeric as employed herein refers to virus that comprises DNA from two or more different serotypes and has oncolytic virus properties.

In one embodiment the oncolytic virus is EnAd or an active derivate thereof which retains the essential beneficial properties of the virus. EnAd is disclosed in WO2005/118825 (incorporated herein by reference) and the full sequence for the virus is provided herein SEQ ID NO: 38. The chimeric E2B region is disclosed herein as SEQ ID NO: 71.

Alternative oncolytic viruses include OvAd1 and OvAd2, which are respectively disclosed as SEQ ID NO: 2 and 3 in WO2008/080003 and incorporated herein by reference.

Advantageously, the adenoviruses of the present disclosure exhibit similar virus activity, for example replication and/or infectivity, profiles to EnAd following infection of a variety of different colon cancer cell lines in vitro.

Structural Elements of Adenoviruses

The present disclosure also relates to the novel sequences of viruses or viral components/constructs, such as plasmids, disclosed herein.

In one embodiment, the adenovirus comprises a genome comprising the sequence of formula (I)

$$5'ITR\text{-}B_1\text{-}B_A\text{-}B_2\text{-}B_X\text{-}B_B\text{-}B_Y\text{-}B_3\text{-}3'ITR \quad (I)$$

wherein: $B_1$ comprises E1A, E1B or E1A-E1B; $B_A$ comprises E2B-L1-L2-L3-E2A-L4; $B_2$ is a bond or comprises E3; $B_X$ is a bond or a DNA sequence comprising a restriction site, one or more transgenes (in particular a transgene encoding at least one bispecific T-cell activator according to the present disclosure, for example under the control of an exogenous promoter) or both; $B_B$ comprises L5; $B_Y$ is a bond or a DNA sequence comprising: a restriction site, one or more transgenes (in particular a transgene encoding at least one bispecific T-cell activator according to the present disclosure, for example under the control of an endogenous promoter, such as the MPL or under the control of an exogenous promoter, such as the CMV promoter) or both; $B_3$ is a bond or comprises E4; wherein at least one of $B_X$ and $B_Y$ is not a bond and comprises a transgene or a restriction site or both; and encodes a multispecific antigen molecule comprising at least two binding domains and at least one of the said domains is specific for a surface antigen on a T cell of interest. In one embodiment, the adenovirus comprises a genome comprising the sequence of formula (I) wherein $B_1 B_X$ is a bond.

In one embodiment, the adenovirus comprises a genome comprising the sequence of formula (I) wherein: $B_Y$ is a bond.

In one embodiment, the adenovirus comprises a genome comprising the sequence of formula (Ia):

$$5'TTR-B_A-B_2-B_X-B_B-B_Y-B_3-3'TTR \quad (Ia)$$

wherein: $B_A$ comprises E2B-L1-L2-L3-E2A-L4; $B_2$ is a bond or comprises E3; $B_X$ is a bond or a DNA sequence comprising a restriction site, one or more transgenes (in particular a transgene encoding at least one bispecific T-cell activator according to the present disclosure, for example under the control of an exogenous promoter) or both; $B_B$ comprises L5; $B_Y$ is a bond or a DNA sequence comprising: a restriction site, one or more transgenes (in particular a transgene encoding at least one bispecific T-cell activator according to the present disclosure, for example under the control of an endogenous promoter, such as the MPL or under the control of an exogenous promoter, such as the CMV promoter) or both; $B_3$ is a bond or comprises E4; wherein at least one of $B_X$ and $B_Y$ is not a bond and at least one comprises a transgene or a restriction site, such as a transgene.

In one embodiment, the adenovirus comprises a genome comprising the sequence of formula (Ia) wherein $B_X$ is a bond.

In one embodiment the adenovirus comprises a genome comprising the sequence of formula (Ia) wherein $B_Y$ is a bond.

In one embodiment, the adenovirus comprises a genome comprising the sequence of formula (Ib):

$$5'TTR-B_A-B_X-B_B-B_Y-B_3-3'TTR \quad (Ib)$$

wherein: $B_A$ comprises E2B-L1-L2-L3-E2A-L4; $B_X$ is a bond or a DNA sequence comprising a restriction site, one or more transgenes (in particular a transgene encoding at least one bispecific T-cell activator according to the present disclosure, for example under the control of an exogenous promoter) or both; $B_B$ comprises L5; $B_Y$ is a bond or a DNA sequence comprising: a restriction site, one or more transgenes (in particular a transgene encoding at least one bispecific T-cell activator according to the present disclosure, for example under the control of an endogenous promoter, such as the MPL or under the control of an exogenous promoter, such as the CMV promoter) or both; $B_3$ is a bond or comprises E4; wherein at least one of $B_X$ and $B_Y$ is not a bond and comprises a transgene or a restriction site or both, such as a transgene.

In one embodiment, the adenovirus comprises a genome comprising the sequence of formula (Ib) wherein $B_X$ is a bond.

In one embodiment, the adenovirus comprises a genome comprising the sequence of formula (Ib) wherein $B_Y$ is a bond.

In one embodiment, the adenovirus comprises a genome comprising the sequence of formula (Ic):

$$5'TTR-B_A-B_2-B_X-B_B-B_Y-3'TTR \quad (Ic)$$

wherein: $B_A$ comprises E2B-L1-L2-L3-E2A-L4; $B_2$ is E3; $B_X$ is a bond or a DNA sequence comprising a restriction site, one or more transgenes (in particular a transgene encoding at least one bispecific T-cell activator according to the present disclosure, for example under the control of an exogenous promoter) or both; $B_B$ comprises L5; $B_Y$ is a bond or a DNA sequence comprising: a restriction site, one or more transgenes (in particular a transgene encoding at least one bispecific T-cell activator according to the present disclosure, for example under the control of an endogenous promoter, such as the MPL or under the control of an exogenous promoter, such as the CMV promoter) or both; wherein at least one of $B_X$ and $B_Y$ is not a bond and comprises a transgene or a restriction site or both, such as a transgene.

In one embodiment, the adenovirus comprises a genome comprising the sequence of formula (Ic) wherein $B_X$ is a bond.

In one embodiment, the adenovirus comprises a genome comprising the sequence of formula (Ic) wherein $B_Y$ is a bond.

In one embodiment the adenovirus comprises a genome comprising the sequence of formula (Id):

$$5'TTR-B_1-B_A-B_X-B_B-B_Y-B_3-3'TTR \quad (Id)$$

wherein: $B_1$ comprises E1A, E1B or E1A-E1B; $B_A$ comprises E2B-L1-L2-L3-E2A-L4; $B_X$ is a bond or a DNA sequence comprising a restriction site, one or more transgenes (in particular a transgene encoding at least one bispecific T-cell activator according to the present disclosure, for example under the control of an exogenous promoter) or both; $B_B$ comprises L5; $B_Y$ is a bond or a DNA sequence comprising: a restriction site, one or more transgenes (in particular a transgene encoding at least one bispecific T-cell activator according to the present disclosure, for example under the control of an endogenous promoter, such as the MPL or under the control of an exogenous promoter, such as the CMV promoter) or both; $B_3$ is a bond or comprises E4; wherein at least one of $B_X$ and $B_Y$ is not a bond and comprises a transgene a restriction site or both.

In one embodiment the adenovirus comprises a genome comprising the sequence of formula (Id) wherein $B_X$ is a bond.

In one embodiment the adenovirus comprises a genome comprising the sequence of formula (Id) wherein $B_Y$ is a bond.

In one embodiment the adenovirus comprises a genome comprising the sequence of formula (Ie):

$$5'TTR-B_1-B_A-B_2-B_B-B_Y-3'TTR \quad (Ie)$$

wherein: $B_1$ comprises E1A, E1B or E1A-E1B; $B_A$ comprises E2B-L1-L2-L3-E2A-L4; $B_2$ comprises E3; $B_B$ comprises L5; $B_Y$ is a bond or a DNA sequence comprising: one or more transgenes encoding at least one bispecific T-cell activator according to the present disclosure (for example under the control of an endogenous promoter, such as the MPL or under the control of an exogenous promoter, such as the CMV promoter); wherein at least one of $B_X$ and $B_Y$ is not a bond and comprises a transgene a restriction site or both.

In one embodiment there is provided a compound of formula (I), (Ia), (Ib), (Ic), (Id) or (Ie) wherein $B_X$ and $B_Y$ is not a bond and comprises a transgene a restriction site or both, such as $B_X$ and $B_Y$ are both a transgene.

In one embodiment of formula (I), (Ia), (Ib), (Ic) or (Id) only $B_X$ encodes one or two bispecific T-cell activators, for example one bispecific T-cell activator (and $B_Y$ does not encode a bispecific T-cell activator), in particular said bispecific T-cell activator or bispecific T-cell activators are under the control of an exogenous promoter, such as the CMV promoter. In one embodiment of formula (I), (Ia), (Ib), (Ic) or (Id) only $B_Y$ encodes one or two bispecific T-cell activators, for example one bispecific T-cell activator (and $B_X$ does not encode a Bispecific T-cell activator), in particular said bispecific T-cell activator or bispecific T-cell activators are under the control of an endogenous promoter, such as the MPL or under the control of an exogenous promoter, such as a CMV promoter. In one embodiment of formula (I), (Ia), (Ib), (Ic) or (Id) $B_X$ encodes a bispecific T-cell activator (for example under the control of an exogenous promoter such as a CMV promoter) and $B_Y$ encodes a bispecific T-cell activator (for example under the control of an endogenous promoter, such as the MPL or under the control of an exogenous promoter such as a CMV promoter).

A bond refers to a covalent bond connecting one DNA sequence to another DNA sequence, for example connecting one section of the virus genome to another. Thus when a variable in formula (I) (Ia), (Ib), (Ic), (Id) or (Ie) herein represents a bond the feature or element represented by the bond is absent i.e. deleted.

As the structure of adenoviruses is, in general, similar the elements below are discussed in terms of the structural elements and the commonly used nomenclature referring thereto, which are known to the skilled person. When an element is referred to herein then we refer to the DNA sequence encoding the element or a DNA sequence encoding the same structural protein of the element in an adenovirus. The latter is relevant because of the redundancy of the DNA code. The viruses' preference for codon usage may need to be considered for optimised results.

Any structural element from an adenovirus employed in the viruses of the present disclosure may comprise or consist of the natural sequence or may have similarity over the given length of at least 95%, such as 96%, 97%, 98%, 99% or 100%. The original sequence may be modified to omit 10%, 9%, 8%, 7%, 6%, 5%, 4%, 3%, 2% or 1% of the genetic material. The skilled person is aware that when making changes the reading frames of the virus must be not disrupted such that the expression of structural proteins is disrupted.

In one embodiment the given element is a full-length sequence i.e. the full-length gene.

In one embodiment the given element is less than a full-length and retains the same or corresponding function as the full-length sequence.

In one embodiment for a given element which is optional in the constructs of the present disclosure, the DNA sequence may be less than a full-length and have no functionality.

The structural genes encoding structural or functional proteins of the adenovirus are generally linked by non-coding regions of DNA. Thus there is some flexibility about where to "cut" the genomic sequence of the structural element of interest (especially non-coding regions thereof) for the purpose of inserting a transgene into the viruses of the present disclosure. Thus for the purposes of the present specification, the element will be considered a structural element of reference to the extent that it is fit for purpose and does not encode extraneous material. Thus, if appropriate the gene will be associated with suitable non-coding regions, for example as found in the natural structure of the virus.

Thus in one embodiment an insert, such as DNA encoding a restriction site and/or transgene, is inserted into a non-coding region of genomic virus DNA, such as an intron or intergenic sequence. Having said this some non-coding regions of adenovirus may have a function, for example in alternative splicing, transcription regulation or translation regulation, and this may need to be taken into consideration.

The sites identified herein, that are associated with the L5 region (for example between L5 and the E4 region), are suitable for accommodating a variety of DNA sequences encoding complex entities such as RNAi, cytokines, single chain or multimeric proteins, such as antibodies, such as a bispecific T-cell activator.

Gene as employed herein refers to coding and any non-coding sequences associated therewith, for example introns and associated exons. In one embodiment a gene comprises or consists of only essential structural components, for example coding region.

Below follows a discussion relating to specific structural elements of adenoviruses.

The Inverted Terminal Repeat (ITR) sequences are common to all known adenoviruses and were so named because of their symmetry, and are the viral chromosome origins of replication.

Another property of these sequences is their ability to form a hairpin.

The 5'ITR as employed herein refers to part or all of an ITR from the 5' end of an adenovirus, which retains the function of the ITR when incorporated into an adenovirus in an appropriate location. In one embodiment the 5'ITR comprises or consists of the sequence from about 1 bp to 138 bp of SEQ ID NO: 38 or a sequence 90, 95, 96, 97, 98 or 99% identical thereto along the whole length, in particular sequence consisting of from about 1 bp to 138 bp of SEQ ID NO: 38.

The 3'ITR as employed herein refers to part or all of an ITR from 3' end of an adenovirus which retains the function of the ITR when incorporated into an adenovirus in an appropriate location. In one embodiment the 3'ITR comprises or consists of the sequence from about 32189 bp to 32326 bp of SEQ ID NO: 38 or a sequence 90, 95, 96, 97, 98 or 99% identical thereto along the whole length, in particular the sequence consisting of from about 32189 bp to 32326 bp of SEQ ID NO: 38.

$B_1$ as employed herein refers to the DNA sequence encoding: part or all of an E1A from an adenovirus, part or all of the E1B region of an adenovirus, and independently part or all of E1A and E1B region of an adenovirus.

When $B_1$ is a bond then E1A and E1B sequences will be omitted from the virus. In one embodiment $B_1$ is a bond and thus the virus is a vector.

In one embodiment $B_1$ further comprises a transgene. It is known in the art that the E1 region can accommodate a transgene which may be inserted in a disruptive way into the E1 region (i.e. in the "middle" of the sequence) or part or all of the E1 region may be deleted to provide more room to accommodate genetic material.

E1A as employed herein refers to the DNA sequence encoding part or all of an adenovirus E1A region. The latter here is referring to the polypeptide/protein E1A. It may be mutated such that the protein encoded by the E1A gene has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

E1B as employed herein refers to the DNA sequence encoding part or all of an adenovirus E1B region (i.e. polypeptide or protein), it may be mutated such that the protein encoded by the E1B gene/region has conservative or non-conservative amino acid changes, such that it has: the same function as wild-type (i.e. the corresponding non-mutated protein); increased function in comparison to wild-type protein; decreased function, such as no function in comparison to wild-type protein; or has a new function in comparison to wild-type protein or a combination of the same as appropriate.

Thus $B_1$ can be modified or unmodified relative to a wild-type E1 region, such as a wild-type E1A and/or E1B. The skilled person can easily identify whether E1A and/or E1B are present or (part) deleted or mutated.

Wild-type as employed herein refers to a known adenovirus. A known adenovirus is one that has been identified and named, regardless of whether the sequence is available.

In one embodiment $B_1$ has the sequence from 139 bp to 3932 bp of SEQ ID NO: 38.

$B_A$ as employed herein refers to the DNA sequence encoding the E2B-L1-L2-L3-E2A-L4 regions including any non-coding sequences, as appropriate. Generally this sequence will not comprise a transgene. In one embodiment the sequence is substantially similar or identical to a contiguous sequence from a known adenovirus, for example a serotype shown in Table 1, in particular a group B virus, for example Ad3, Ad7, Ad11, Ad14, Ad16, Ad21, Ad34, Ad35, Ad51 or a combination thereof, such as Ad3, Ad11 or a combination thereof. In one embodiment is E2B-L1-L2-L3-E2A-L4 refers to comprising these elements and other structural elements associated with the region, for example $B_A$ will generally include the sequence encoding the protein IV2a, for example as follows: IV2A IV2a-E2B-L1-L2-L3-E2A-L4

In one embodiment the E2B region is chimeric. That is, comprises DNA sequences from two or more different adenoviral serotypes, for example from Ad3 and Ad11, such as Ad11p. In one embodiment the E2B region has the sequence from 5068 bp to 10355 bp of SEQ ID NO: 38 or a sequence 95%, 96%, 97%, 98% or 99% identical thereto over the whole length.

In one embodiment the E2B in component $B_A$ comprises the sequences shown in SEQ ID NO: 71 (which corresponds to SEQ ID NO: 3 disclosed in WO2005/118825).

In one embodiment $B_A$ has the sequence from 3933 bp to 27184 bp of SEQ ID NO: 38.

E3 as employed herein refers to the DNA sequence encoding part or all of an adenovirus E3 region (i.e. protein/polypeptide), it may be mutated such that the protein encoded by the E3 gene has conservative or non-conservative amino acid changes, such that it has the same function as wild-type (the corresponding unmutated protein); increased function in comparison to wild-type protein; decreased function, such as no function in comparison to wild-type protein or has a new function in comparison to wild-type protein or a combination of the same, as appropriate.

In one embodiment the E3 region is form an adenovirus serotype given in Table 1 or a combination thereof, in particular a group B serotype, for example Ad3, Ad7, Ad11 (in particular Ad11p), Ad14, Ad16, Ad21, Ad34, Ad35, Ad51 or a combination thereof, such as Ad3, Ad11 (in particular Ad11p) or a combination thereof.

In one embodiment the E3 region is partially deleted, for example is 95%, 90%, 85%, 80%, 75%, 70%, 65%, 60%, 55%, 50%, 45%, 40%, 35%, 30%, 25%, 20%, 15%, 10%, 5% deleted. In one embodiment $B_2$ is a bond, wherein the DNA encoding the E3 region is absent.

In one embodiment the DNA encoding the E3 region can be replaced or interrupted by a transgene. As employed herein "E3 region replaced by a transgene as employed herein includes part or all of the E3 region is replaced with a transgene.

In one embodiment the $B_2$ region comprises the sequence from 27185 bp to 28165 bp of SEQ ID NO: 38.

In one embodiment $B_2$ consists of the sequence from 27185 bp to 28165 bp of SEQ ID NO: 38.

$B_X$ as employed herein refers to the DNA sequence in the vicinity of the 5' end of the LS gene in $B_B$. In the vicinity of or proximal to the 5' end of the LS gene as employed herein refers to: adjacent (contiguous) to the 5' end of the LS gene or a non-coding region inherently associated herewith i.e. abutting or contiguous to the 5' prime end of the LS gene or a non-coding region inherently associated therewith. Alternatively, in the vicinity of or proximal to may refer to being close the LS gene, such that there are no coding sequences between the $B_X$ region and the 5' end of LS gene.

Thus in one embodiment $B_X$ is joined directly to a base of LS which represents, for example the start of a coding sequence of the LS gene.

Thus in one embodiment $B_X$ is joined directly to a base of LS which represents, for example the start of a non-coding sequence, or joined directly to a non-coding region naturally associated with LS. A non-coding region naturally associated LS as employed herein refers to part of all of a non-coding regions which is part of the LS gene or contiguous therewith but not part of another gene.

In one embodiment $B_X$ comprises the sequence of SEQ ID NO: 39. This sequence is an artificial non-coding sequence wherein a DNA sequence, for example comprising a transgene (or transgene cassette), a restriction site or a combination thereof may be inserted therein. This sequence is advantageous because it acts as a buffer in that allows some flexibility on the exact location of the transgene whilst minimising the disruptive effects on virus stability and viability.

The insert(s) can occur anywhere within SEQ ID NO: 39 from the 5' end, the 3' end or at any point between bp 1 to 201, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, 34/35, 35/36, 36/37, 37/38, 38/39, 39/40, 40/41, 41/42, 42/43, 43/44, 44/45, 45/46, 46/47, 47/48, 48/49, 49/50, 50/51, 51/52, 52/53, 53/54, 54/55, 55/56, 56/57, 57/58, 58/59, 59/60, 60/61, 61/62, 62/63, 63/64, 64/65, 65/66, 66/67, 67/68, 68/69, 69/70, 70/71, 71/72, 72/73, 73/74, 74/75, 75/76, 76/77, 77/78, 78/79, 79/80, 80/81, 81/82, 82/83, 83/84, 84/85, 85/86, 86/87, 87/88, 88/89, 89/90, 90/91, 91/92, 92/93, 93/94, 94/95, 95/96, 96/97, 97/98, 98/99, 99/100, 100/101, 101/102, 102/103, 103/104, 104/105, 105/106, 106/107, 107/108, 108/109, 109/110, 110/111, 111/112, 112/113, 113/114, 114/115, 115/116, 116/117, 117/118, 118/119, 119/120, 120/121, 121/122, 122/123, 123/124, 124/125, 125/126, 126/127, 127/128, 128/129, 129/130, 130/131, 131/132, 132/133, 133/134, 134/135, 135/136, 136/137, 137/138, 138/139, 139/140, 140/141, 141/142, 142/143, 143/144, 144/145, 145/146, 146/147, 147/148, 148/149, 150/151, 151/152, 152/153, 153/154, 154/155, 155/156, 156/157, 157/158, 158/159, 159/160, 160/161, 161/162, 162/163, 163/164, 164/165, 165/166, 166/167, 167/168, 168/169, 169/170, 170/171, 171/172, 172/173, 173/174, 174/175, 175/176, 176/177, 177/178, 178/179, 179/180, 180/181, 181/182, 182/183, 183/184, 184/185, 185/186, 186/187, 187/188, 189/190, 190/191, 191/192, 192/193, 193/194, 194/195, 195/196, 196/197, 197/198, 198/199, 199/200 or 200/201.

In one embodiment B$_X$ comprises SEQ ID NO: 39 with a DNA sequence inserted between bp 27 and bp 28 or a place corresponding to between positions 28192 bp and 28193 bp of SEQ ID NO: 38.

In one embodiment the insert is a restriction site insert. In one embodiment the restriction site insert comprises one or two restriction sites. In one embodiment the restriction site is a 19 bp restriction site insert comprising 2 restriction sites. In one embodiment the restriction site insert is a 9 bp restriction site insert comprising 1 restriction site. In one embodiment the restriction site insert comprises one or two restriction sites and at least one transgene, for example one or two transgenes. In one embodiment the restriction site is a 19 bp restriction site insert comprising 2 restriction sites and at least one transgene, for example one or two transgenes. In one embodiment the restriction site insert is a 9 bp restriction site insert comprising 1 restriction site and at least one transgene, for example one, two or three transgenes, such as one or two. In one embodiment two restriction sites sandwich one or more, such as two transgenes (for example in a transgene cassette). In one embodiment when B$_X$ comprises two restrictions sites the said restriction sites are different from each other. In one embodiment said one or more restrictions sites in B$_X$ are non-naturally occurring in the particular adenovirus genome into which they have been inserted. In one embodiment said one or more restrictions sites in B$_X$ are different to other restrictions sites located elsewhere in the adenovirus genome, for example different to naturally occurring restrictions sites and/or restriction sites introduced into other parts of the genome, such as a restriction site introduced into B$_Y$. Thus in one embodiment the restriction site or sites allow the DNA in the section to be cut specifically.

Advantageously, use of "unique" restriction sites provides selectivity and control over the where the virus genome is cut, simply by using the appropriate restriction enzyme.

Cut specifically as employed herein refers to where use of an enzyme specific to the restriction sites cuts the virus only in the desired location, usually one location, although occasionally it may be a pair of locations. A pair of locations as employed herein refers to two restrictions sites in proximity of each other that are designed to be cut by the same enzyme (i.e. cannot be differentiated from each other).

In one embodiment the restriction site insert is SEQ ID NO: 50.

In one embodiment B$_X$ has the sequence from 28166 bp to 28366 bp of SEQ ID NO: 38.

In one embodiment B$_X$ is a bond.

In one embodiment B$_X$ comprises a restriction site, for example 1, 2, 3 or 4 restriction sites, such as 1 or 2. In one embodiment B$_X$ comprises at least one transgene, for example 1 or 2 transgenes. In one embodiment B$_X$ comprises at least one transgene, for example 1 or 2 transgenes and one or more restriction sites, for example 2 or 3 restriction sites, in particular where the restrict sites sandwich a gene or the DNA sequence comprising the genes to allow it/them to be specifically excised from the genome and/or replaced. Alternatively, the restriction sites may sandwich each gene, for example when there are two transgenes three different restriction sites are required to ensure that the genes can be selectively excised and/or replaced. In one embodiment one or more, for example all the transgenes are in the form a transgene cassette. In one embodiment B$_X$ comprises SEQ ID NO: 39. In one embodiment SEQ ID NO: 39 is interrupted, for example by a transgene. In embodiment SEQ ID NO: 39 is uninterrupted. In one embodiment B$_X$ does not comprise a restriction site. In one embodiment B$_X$ is a bond. In one embodiment B$_X$ comprises or consists of one or more transgenes.

In one embodiment B$_Y$ comprises a restriction site, for example 1, 2, 3 or 4 restriction sites, such as 1 or 2. In one embodiment B$_Y$ comprises at least one transgene, for example 1 or 2 transgenes. In one embodiment B$_Y$ comprises at least one transgene, for example 1 or 2 transgenes and one or more restriction sites, for example 2 or 3 restriction sites, in particular where the restrict sites sandwich a gene or the DNA sequence comprising the genes to allow it/them to be specifically excised from the genome and/or replaced. Alternatively the restriction sites may sandwich each gene, for example when there are two transgenes three different restriction sites are required to ensure that the genes can be selectively excised and/or replaced. In one embodiment one or more, for example all the transgenes are in the form a transgene cassette. In one embodiment B$_Y$ comprises SEQ ID NO: 40. In one embodiment SEQ ID NO: 40 is interrupted, for example by a transgene. In embodiment SEQ ID NO: 40 is uninterrupted. In one embodiment B$_Y$ does not comprise a restriction site. In one embodiment B$_Y$ is a bond. In one embodiment B$_Y$ comprises or consists of one or more transgenes.

In one embodiment B$_X$ and B$_Y$ each comprises a restriction site, for example 1, 2, 3 or 4 restriction sites, such as 1 or 2. In one embodiment B$_X$ and B$_Y$ each comprises at least one transgene, for example 1 or 2 transgenes. In one embodiment B$_X$ and B$_Y$ each comprises at least one transgene, for example 1 or 2 transgenes and one or more restriction sites, for example 2 or 3 restriction sites, in particular where the restriction sites sandwich a gene or the DNA sequence comprising the genes to allow it to be specifically excised from the genome and/or replaced. Alternatively the restriction sites may sandwich each gene, for example when there are two transgenes three different restriction sites are required to ensure that the genes can be selectively excised and/or replaced. In one embodiment one or more, for example all the transgenes are in the form a transgene cassette. In one embodiment B$_X$ and B$_Y$ comprises SEQ ID NO: 39 and SEQ ID NO: 40 respectively. In one embodiment B$_X$ and B$_Y$ do not comprise a restriction site. In one embodiment B$_X$ is a bond and B$_Y$ is not a bond. In one embodiment B$_Y$ is a bond and B$_X$ is not a bond.

B$_B$ as employed herein refers to the DNA sequence encoding the L5 region. As employed herein the L5 region refers to the DNA sequence containing the gene encoding the fibre polypeptide/protein, as appropriate in the context. The fibre gene/region encodes the fibre protein which is a major capsid component of adenoviruses. The fibre functions in receptor recognition and contributes to the adenovirus' ability to selectively bind and infect cells.

In viruses of the present disclosure the fibre can be from any adenovirus strain of serotype 11, such as Ad11p.

In one embodiment B$_B$ has the sequence from 28367 bp to 29344 bp of SEQ ID NO: 38.

DNA sequence in relation to B$_Y$ as employed herein refers to the DNA sequence in the vicinity of the 3' end of the L5 gene of B$_B$. In the vicinity of or proximal to the 3' end of the L5 gene as employed herein refers to: adjacent (contiguous) to the 3' end of the L5 gene or a non-coding region inherently associated therewith i.e. abutting or contiguous to the 3' prime end of the L5 gene or a non-coding region inherently associated therewith (i.e. all or part of an non-coding sequence endogenous to LS). Alternatively, in the vicinity of or proximal to may refer to being close the LS gene, such that there are no coding sequences between the $B_Y$ region and the 3' end of the LS gene.

Thus, in one embodiment $B_Y$ is joined directly to a base of LS which represents the "end" of a coding sequence.

Thus, in one embodiment $B_Y$ is joined directly to a base of LS which represents the "end" of a non-coding sequence, or joined directly to a non-coding region naturally associated with LS.

Inherently and naturally are used interchangeably herein. In one embodiment $B_Y$ comprises the sequence of SEQ ID NO: 40. This sequence is a non-coding sequence wherein a DNA sequence, for example comprising a transgene (or transgene cassette), a restriction site or a combination thereof may be inserted. This sequence is advantageous because it acts a buffer in that allows some flexibility on the exact location of the transgene whilst minimising the disruptive effects on virus stability and viability.

The insert(s) can occur anywhere within SEQ ID NO: 40 from the 5' end, the 3' end or at any point between bp 1 to 35, for example between base pairs 1/2, 2/3, 3/4, 4/5, 5/6, 6/7, 7/8, 8/9, 9/10, 10/11, 11/12, 12/13, 13/14, 14/15, 15/16, 16/17, 17/18, 18/19, 19/20, 20/21, 21/22, 22/23, 23/24, 24/25, 25/26, 26/27, 27/28, 28/29, 29/30, 30/31, 31/32, 32/33, 33/34, or 34/35.

In one embodiment $B_Y$ comprises SEQ ID NO: 40 with a DNA sequence inserted between positions bp 12 and 13 or a place corresponding to 29356 bp and 29357 bp in SEQ ID NO: 38. In one embodiment the insert is a restriction site insert. In one embodiment the restriction site insert comprises one or two restriction sites. In one embodiment the restriction site is a 19 bp restriction site insert comprising 2 restriction sites. In one embodiment the restriction site insert is a 9 bp restriction site insert comprising 1 restriction site. In one embodiment the restriction site insert comprises one or two restriction sites and at least one transgene, for example one or two or three transgenes, such as one or two transgenes. In one embodiment the restriction site is a 19 bp restriction site insert comprising 2 restriction sites and at least one transgene, for example one or two transgenes. In one embodiment, the restriction site insert is a 9 bp restriction site insert comprising 1 restriction site and at least one transgene, for example one or two transgenes. In one embodiment two restriction sites sandwich one or more, such as two transgenes (for example in a transgene cassette). In one embodiment when $B_Y$ comprises two restrictions sites the said restriction sites are different from each other. In one embodiment said one or more restrictions sites in $B_Y$ are non-naturally occurring (such as unique) in the particular adenovirus genome into which they have been inserted. In one embodiment said one or more restrictions sites in $B_Y$ are different to other restrictions sites located elsewhere in the adenovirus genome, for example different to naturally occurring restrictions sites or restriction sites introduced into other parts of the genome, such as $B_X$. Thus, in one embodiment the restriction site or sites allow the DNA in the section to be cut specifically.

In one embodiment, the restriction site insert is SEQ ID NO: 51.

In one embodiment $B_Y$ has the sequence from 29345 bp to 29379 bp of SEQ ID NO: 38.

In one embodiment $B_Y$ is a bond.

In one embodiment, the insert is after bp 12 in SEQ ID NO: 40.

In one embodiment, the insert is at about position 29356 bp of SEQ ID NO: 38.

In one embodiment, the insert is a transgene cassette comprising one or more transgenes, for example 1, 2 or 3, such as 1 or 2.

E4 as employed herein refers to the DNA sequence encoding part or all of an adenovirus E4 region (i.e. polypeptide/protein region), which may be mutated such that the protein encoded by the E4 gene has conservative or non-conservative amino acid changes, and has the same function as wild-type (the corresponding non-mutated protein); increased function in comparison to wild-type protein; decreased function, such as no function in comparison to wild-type protein or has a new function in comparison to wild-type protein or a combination of the same as appropriate. In one embodiment the E4 region has E4orf4 deleted.

In one embodiment the E4 region is partially deleted, for example is 95%, 90%, 85%, 80%, 75%, 70%, 65%, 60%, 55%, 50%, 45%, 40%, 35%, 30%, 25%, 20%, 15%, 10% or 5% deleted. In one embodiment the E4 region has the sequence from 32188 bp to 29380 bp of SEQ ID NO: 38.

In one embodiment $B_3$ is a bond, i.e. wherein E4 is absent.

In one embodiment $B_3$ has the sequence consisting of from 32188 bp to 29380 bp of SEQ ID NO: 38.

As employed herein number ranges are inclusive of the end points.

The skilled person will appreciate that the elements in the formulas herein, such as formula (I), (Ia), (Ib), (Ic), (Id) and (Ie) are contiguous and may embody non-coding DNA sequences as well as the genes and coding DNA sequences (structural features) mentioned herein. In one or more embodiments, the formulas of the present disclosure are attempting to describe a naturally occurring sequence in the adenovirus genome. In this context, it will be clear to the skilled person that the formula is referring to the major elements characterising the relevant section of genome and is not intended to be an exhaustive description of the genomic stretch of DNA.

E1A, E1B, E3 and E4 as employed herein each independently refer to the wild-type and equivalents thereof, mutated or partially deleted forms of each region as described herein, in particular a wild-type sequence from a known adenovirus.

"Insert" as employed herein refers to a DNA sequence that is incorporated either at the 5' end, the 3' end or within a given DNA sequence reference segment such that it interrupts the reference sequence. The latter is a reference sequence employed as a reference point relative to which the insert is located. In the context of the present disclosure inserts generally occur within either SEQ ID NO: 10 or SEQ ID NO: 11. An insert can be either a restriction site insert, a transgene cassette or both. When the sequence is interrupted the virus will still comprise the original sequence, but generally it will be as two fragments sandwiching the insert.

In one embodiment the transgene or transgene cassette does not comprise a non-biased inserting transposon, such as a TN7 transposon or part thereof. Tn7 transposon as employed herein refers to a non-biased insertion transposon as described in WO2008/080003.

In one embodiment one or more restrictions sites in $B_X$ and $B_Y$ are independently selected from a restriction site specific to an enzyme described herein, for example NotI, FseI, AsiSI, SgfI and SbfI, in particular the restriction sites inserted are all different, such as sites specific for NotI and sites specific for FseI located in $B_X$ and SgfI and SbfI located in $B_Y$.

As discussed above in one embodiment the region $B_X$ and/or $B_Y$ do not comprise a restriction site. Advantageously, the viruses and constructs of the present disclosure can be prepared without restriction sites, for example using synthetic techniques. These techniques allow a great flexibility in the creation of the viruses and constructs. Furthermore, the present inventors have established that the properties of the viruses and constructs are not diminished when they are prepared by synthetic techniques.

Promoters

Promoter as employed herein means a region of DNA that initiates transcription of a particular gene or genes. Promoters are generally located proximal to the genes they transcribe, on the same strand and upstream (i.e. 5') on the DNA. Proximal as employed in this context means sufficiently close to function as a promoter. In one embodiment, the promoter is within 100 bp of the transcription start site. Thus, endogenous promoter as employed herein refers to a promoter that naturally occurs in (i.e. is native to) the adenovirus (or construct) into which the transgene, is being inserted. In one or more embodiments, the endogenous promoter employed is the naturally occurring promoter in the virus in its original location in the virus genome, in particular this is the primary or only promoter employed in the expression of the transgene or transgenes. In one embodiment the endogenous promoter used to promote the translation and optionally the transcription of the transgene is one resident, i.e. is one integrated in the genome of the adenovirus and not previously introduced by recombinant techniques.

Under the control of an endogenous promoter as employed herein refers to where the transgene/transgene cassette is inserted in the appropriate orientation to be under the control of said endogenous promoter. That is, where the promoter is generally on the antisense strand, the cassette is inserted, for example in the antisense orientation.

Having said this, genes can be expressed in one of two orientations. However, generally one orientation provides increased levels of expression over the other orientation, for a given (particular) transgene.

In one embodiment, the cassette is in the sense orientation. That is, is transcribed in a 5' to 3' direction. In one embodiment, the cassette is in the antisense orientation. That is, transcribed in the 3' to 5' orientation.

The endogenous promoters in the virus can, for example, be utilised by employing a gene encoding a transgene and a splice acceptor sequence. Thus in one embodiment the cassette will comprise a splice acceptor sequence when under the control of an endogenous promoter. Thus in one embodiment the coding sequence, for example the sequence encoding the antibody or antibody binding fragment further comprises a splice acceptor sequence.

In one embodiment the transgene, transgenes, or transgene cassette are under the control of an E4 promoter or a major late promoter, such as the major late promoter (ML promoter).

Under the control of as employed herein means that the transgene is activated, i.e. transcribed, when a particular promoter dictates.

The Major Late Promoter (ML promoter or MLP) as employed herein refers to the adenovirus promoter that controls expression of the "late expressed" genes, such as the L5 gene. The MLP is a "sense strand" promoter. That is, the promoter influences genes that are downstream of the promoter in the 5'-3' direction. The major late promoter as employed herein refers the original major late promoter located in the virus genome.

E4 promoter as employed herein refers to the adenovirus promoter of the E4 region. The E4 region is an antisense region; therefore the promoter is an antisense promoter. That is, the promoter is upstream of the E4 region in the 3'-5' direction. Therefore any transgene cassette under control of the E4 promoter may need to be oriented appropriately. In one embodiment the cassette under the control of the E4 promoter is in the antisense orientation. In one embodiment the cassette is under the control of the E4 promoter in the sense orientation. The E4 promoter as employed herein refers to the original E4 promoter located in the virus genome.

Thus in one embodiment there is provided a replication competent oncolytic adenovirus serotype 11 (such as Ad11p) or virus-derivative thereof wherein the fibre, hexon and capsid are serotype 11 (such as Ad11p), wherein the virus genome comprises a DNA sequence encoding a therapeutic antibody or antibody-binding fragment (such as a bispecific T-cell activator), wherein said DNA sequence under the control of a promoter endogenous to the adenovirus selected from consisting of E4 and the major late promoter (i.e. the E4 promoter or the major late promoter), such that the transgene does not interfere with virus replication, for example is associated with the L5 region (i.e. before or after said region), such as located after L5 in the virus genome, in particular located between L5 and the E4 region.

In one embodiment, an endogenous promoter is introduced into the viral genome at a desired location by recombinant techniques, for example is introduced in the transgene cassette. However, in the context of the present specification this arrangement will generally be referred to as an exogenous promoter.

In one embodiment, the transgene cassette comprises an exogenous promoter. Exogenous promoter as employed herein refers to a promoter that is not naturally occurring in the adenovirus into which the transgene is being inserted. Typically, exogenous promoters are from other viruses or are mammalian promoters. Exogenous promoter as employed herein means a DNA element, usually located upstream of the gene of interest, that regulates the transcription of the gene.

In one embodiment, the regulator of gene expression is an exogenous promoter, for example CMV (cytomegalovirus promoter), CBA (chicken beta actin promoter) or PGK (phosphoglycerate kinase 1 promoter), such as CMV promoter.

In one embodiment, the CMV exogenous promoter employed has the nucleotide sequence of SEQ ID NO: 52. In one embodiment the PGK exogenous promoter employed has the nucleotide sequence of SEQ ID NO: 53. In one embodiment the CBA exogenous promoter employed has the nucleotide sequence of SEQ ID NO: 54.

In one embodiment there is provided a replication competent oncolytic adenovirus serotype 11 (such as Ad11p) or virus-derivative thereof wherein the fibre, hexon and capsid are serotype 11 (such as Ad11p), wherein the virus genome comprises a DNA sequence encoding a therapeutic antibody or antibody-binding fragment (such as a bispecific T-cell activator according to the present disclosure) located in a part of the virus genome which is expressed late in the virus replication cycle and such that the transgene does not interfere with virus replication, wherein said DNA sequence under the control of a promoter exogenous to the adenovirus (for example the CMV promoter). In one embodiment the DNA sequence encoding an antibody or fragment (such as a bispecific T-cell activator according to the present disclosure) is associated with the L5 region as described elsewhere herein, in particular located between L5 and E4 region.

In one embodiment, the exogenous promoter is an antigen-presenting cell promoter. Antigen-presenting cell promoter as employed herein refers to a promoter for a gene that is selectively expressed by antigen-presenting cells, such as dendritic cells or macrophages. Such genes include but are not limited to: FLT-3, FLT-3 ligand, TLRs, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILT5, ILT7, TSLP Receptor, CD141, CD303, CADM1, CLEC9a, XCR1 or CD304; antigen processing and presentation mediators such as CTIIA or GILT. Thus in one embodiment the exogenous promoter is suitable for selective expression of transgenes in said antigen-presenting cells.

Other Regulatory Sequences

"Regulator of gene expression" (or regulator/regulatory element) as employed herein refers to a genetic feature, such as a promoter, enhancer or a splice acceptor sequence that plays a role in gene expression, typically by initiating or enhancing transcription or translation.

"Splice acceptor sequence", "splice acceptor" or "splice site" as employed herein refers to a regulatory sequence determining when an mRNA molecule will be recognised by small nuclear ribonucleoproteins of the spliceosome complex. Once assembled the spliceosome catalyses splicing between the splice acceptor site of the mRNA molecule to an upstream splice donor site producing a mature mRNA molecule that can be translated to produce a single polypeptide or protein.

Different sized splice acceptor sequences may be employed in the present invention and these can be described as short splice acceptor (small), splice acceptor (medium) and branched splice acceptor (large).

SSA as employed herein means a short splice acceptor, typically comprising just the splice site, for example 4 base pairs. SA as employed herein means a splice acceptor, typically comprising the short splice acceptor and the polypyrimidine tract, for example 16 bp. bSA as employed herein means a branched splice acceptor, typically comprising the short splice acceptor, polypyrimidine tract and the branch point, for example 26 base pairs.

In one embodiment, the splice acceptor employed in the constructs of the disclosure are shown in SEQ ID NO: 55 to 57. In one embodiment, the SSA has the nucleotide sequence of SEQ ID NO: 55. In one embodiment the SA has the nucleotide sequence of SEQ ID NO: 56. In one embodiment the bSA has the nucleotide sequence of SEQ ID NO: 57. In one embodiment the splice acceptor sequence is independently selected from the group comprising: TGCTAATCTT CCTTTCTCTC TTCAGG (SEQ ID NO: 57), CCTTTCTCTCTT CAGG (SEQ ID NO: 56), and CAGG (SEQ ID NO: 55).

In one embodiment the splice site is immediately proceeded (i.e. followed in a 5' to 3' direction) by a consensus Kozak sequence comprising CCACC. In one embodiment the splice site and the Kozak sequence are interspersed by up to 100 or less base pairs. In one embodiment the Kozak sequence has the nucleotide sequence of SEQ ID NO: 58.

Typically, when under the control of an endogenous or exogenous promoter (such as an endogenous promoter), the coding sequence will be immediately preceded by a Kozak sequence. The start of the coding region is indicated by the initiation codon (AUG), for example is in the context of the sequence (gcc)gccRccAUGg [SEQ ID NO: 59] the start of the "start" of the coding sequences is indicated by the bases in bold. A lower case letter denotes common bases at this position (which can nevertheless vary) and upper case letters indicate highly-conserved bases, i.e. the 'AUGG' sequence is constant or rarely, if ever, changes; 'R' indicates that a purine (adenine or guanine) is usually observed at this position and the sequence in brackets (gcc) is of uncertain significance. Thus in one embodiment the initiation codon AUG is incorporated into a Kozak sequence.

Internal Ribosome Entry DNA Sequence as employed herein refers to a DNA sequence encoding an Internal Ribosome Entry Sequence (IRES). IRES as employed herein means a nucleotide sequence that allows for initiation of translation a messenger RNA (mRNA) sequence, including initiation starting within an mRNA sequence. This is particularly useful when the cassette encodes polycistronic mRNA. Using an IRES results in a polycistronic mRNA that is translated into multiple individual proteins or peptides. In one embodiment the Internal Ribosome Entry DNA sequence has the nucleotide sequence of SEQ ID NO: 60. In one embodiment a particular IRES is only used once in the genome. This may have benefits with respect to stability of the genome.

"High self-cleavage efficiency 2A peptide" or "2A peptide" as employed herein refers to a peptide which is efficiently cleaved following translation. Suitable 2A peptides include P2A, F2A, E2A and T2A. The present inventors have noted that once a specific DNA sequence encoding a given 2A peptide is used once, the same specific DNA sequence may not be used a second time. However, redundancy in the DNA code may be utilised to generate a DNA sequence that is translated into the same 2A peptide. Using 2A peptides is particularly useful when the cassette encodes polycistronic mRNA. Using 2A peptides results in a single polypeptide chain being translated which is modified post-translation to generate multiple individual proteins or peptides.

In one embodiment the encoded P2A peptide employed has the amino acid sequence of SEQ ID NO: 61. In one embodiment the encoded F2A peptide employed has the amino acid sequence of SEQ ID NO: 62. In one embodiment the encoded E2A peptide employed has the amino acid sequence of SEQ ID NO: 63. In one embodiment the encoded T2A peptide employed has the amino acid sequence of SEQ ID NO: 64.

In one embodiment an mRNA or each mRNA encoded by a transgene(s) comprise a polyadenylation signal sequence, such as typically at the end of an mRNA sequence, for example as shown in SEQ ID NO: 65. Thus one embodiment the transgene or the transgene cassette comprises at least one sequence encoding a polyadenylation signal sequence.

"PolyA", "Polyadenylation signal" or "polyadenylation sequence" as employed herein means a DNA sequence, usually containing an AATAAA site, that once transcribed can be recognised by a multiprotein complex that cleaves and polyadenylates the nascent mRNA molecule.

In one embodiment the polyadenylation sequence has the nucleotide sequence of SEQ ID NO: 65.

In one embodiment the construct does not include a polyadenylation sequence. In one embodiment the regulator of gene expression is a splice acceptor sequence.

In one embodiment the sequence encoding a protein/polypeptide/peptide, such as an antibody or antibody fragment (such as a bispecific T-cell activator according to the present disclosure) further comprises a polyadenylation signal.

Molecules Encoded by Transgene

As described herein the at least one transgene in the virus encodes a bispecific T-cell activator, wherein one binding domain is specific for T cell surface antigen. The second binding domain may target and suitable antigen, for example a pathogen antigen, a cancer antigen, a stromal antigen.

Cancer antigens (also referred to as tumor antigens) are one category of particular interest and include for example selected from CEA, MUC-1, EpCAM, HER receptors HER1, HER2, HER3, HER4, PEM, A33, G250, carbohydrate antigens Le$^y$, Le$^x$, Le$^b$, PSMA, TAG-72, STEAP1, CD166, CD24, CD44, E-cadherin, SPARC, ErbB2, ErbB3, WT1, MUC1, LMP2, idiotype, HPV E6&E7, EGFRvIII, HER-2/neu, MAGE A3, p53 nonmutant, p53 mutant, NY-ESO-1, GD2, PSMA, PCSA, PSA, MelanA/MART1, Ras mutant, proteinase3 (PR1), bcr-abl, tyrosinase, survivin, PSA, hTERT, particularly WT1, MUC1, HER-2/neu, NY-ESO-1, survivin and hTERT.

Stromal antigens include fibroblast antigens for example those described herein such as FAP, tumor associated macrophage antigens, and myeloid derived suppressor cell antigens, for example include CD163, CD206, CD68, CD11c, CD11b, CD14, CSF1 receptor, CD15, CD33 and CD66b.

The targets list below may, if appropriate, be encoded in bispecific T-cell activators according to the present disclose or alternatively may be provided as a further therapeutic transgene, or both.

In one embodiment, the transgene or transgenes independently encode a protein, peptide, RNA molecule, such as an RNA molecule. Advantageously the transgene can be delivered intra-cellularly and can subsequently be transcribed and if appropriate translated. Examples of genetic material encoded by a transgene include, for example antibodies or binding fragments thereof, chemokines, cytokines, immunmodulators, enzymes (for example capable of converting pro-drug in the active agent) and an RNAi molecule.

Peptide as employed herein refers to an amino acid sequence of 2 to 50 residues, for example 5 to 20 residues. Polypeptide as employed herein refers to an amino acid sequence of more than 50 residues without tertiary structure, in particular without secondary and tertiary structure. Protein refers to an amino acid sequence of more than 50 residues, with secondary and/or tertiary structure, in particular with second and tertiary structure.

In one embodiment, the coding sequence encodes a therapeutic RNA, therapeutic peptide, therapeutic polypeptide or therapeutic protein (i.e. is a therapeutic gene).

Immunomodulator gene or transgene as employed here means a gene that encodes a peptide or protein molecule that can qualitatively or quantitatively modify an activity or activities of cells of the immune system.

Therapeutic gene as employed herein means a gene that encodes an entity that may be useful in the treatment, amelioration or prevention of disease, for example the gene expresses a therapeutic protein, polypeptide, peptide or RNA, which at least slows down, halts or reverses the progression of a disease, such as cancer.

In one embodiment the entity encoded by the transgene when transcribed or translated in a cell, such as a cancer cell, increases production of danger signals by the cell. "Danger signals" as employed herein refers to a variety of molecules produced by cells undergoing injury, stress or non-apoptotic death that act as alarm signals, for example by stimulating cells of the innate immune system to respond directly as well as serving to enhance activation of cells of the adaptive immune system.

It is known that the microenvironment of tumours often changes such that natural human immune responses are down regulated. Thus the ability to re-start the immune responses from within the tumour is potentially very interesting in the treatment of cancer.

In one embodiment the encoded therapeutic peptide or protein is designed to be secreted into the extracellular environment. In one embodiment the functional RNA, peptide, polypeptide or protein, such as the antibody is released into the external microenvironment of the cell, for example into the culture supernatant, or in vivo: tissue, stroma, circulation, blood and/or lymphatic system.

In one embodiment the peptide, polypeptide or protein (including a bispecific T-cell activator according to the present disclosure), encoded by the transgene, comprises a signal sequence. Signal peptide as employed herein refers to a short 13-36 residue peptide sequence located at the N-terminal of proteins which assist the entry of the protein into the secretory pathway for secretion or membrane expression. In one embodiment, the leader sequence (signal peptide) has the amino acid sequence of SEQ ID NO: 66 or 67.

In another embodiment the encoded therapeutic peptide or protein, such as an antibody is designed to be expressed as a membrane-anchored form in the surface membrane of the cell, for example by including encoding a transmembrane domain in the protein or a site for attachment of a lipid membrane anchor. Generally the bispecific T-cell activator or bispecific T-cell activators of the present disclosure are not expressed as a cell surface anchor format.

In one embodiment the functional RNA, peptide, polypeptide or protein, such as an antibody is released from the cell infected by the adenovirus, for example by active secretion or as a result of cell lysis. Thus in one embodiment the adenovirus lyses the cell, thereby releasing the functional RNA, peptide, polypeptide or protein, such as the antibody.

In another embodiment the encoded further therapeutic peptide or protein, such as an antibody is designed to be retained within the intact cell.

Advantageously, functional RNA, peptide, polypeptide or protein, such as antibodies expressed by adenoviruses of the present disclosure can be detected in tissue in vivo as both mRNA and antibody protein. Furthermore, the expressed functional RNA, peptide or protein, such as the antibody can bind its ligand in ELISA. Yet further, the functional RNA, peptide, polypeptide or protein, such as the antibody is detectable early (e.g. within 3 days of infection) and the expression is sustained over several weeks.

In one embodiment adenoviruses of the present disclosure express functional RNA, peptide, polypeptide or protein, such as antibodies within about 3 days or more of infection, such as within about 36, 48, 60 or 72 hours, or such as 2, 3, 4, 5 or 6 days.

In one embodiment adenoviruses of the present disclosure express functional RNA, peptide, polypeptide or protein, such as antibodies for several weeks, such as about 1, 2, 3, 4, 5 or 6 weeks. Such as 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41 or 42 days.

Advantageously, functional RNA, peptide or protein expression, such as antibody expression is sufficiently high to be able to detect the functional RNA, peptide, polypeptide or protein, such as the antibody in the blood.

In one embodiment, functional RNA, peptide or protein, such as antibodies expressed by the adenovirus of the present disclosure enter the blood stream and/or lymphatic system.

In one embodiment, the adenovirus of the present disclosure is an oncolytic virus which has an enhanced therapeutic index for cancer cells.

In one embodiment, the coding sequence further encodes functional RNA, for example therapeutic RNA.

Functional RNA as employed herein refers to RNA which has a function other than to encode a protein or peptide and includes for examples include RNA constructs suitable for inhibiting or reducing gene activity, including RNAi, such as shRNA and miRNA. shRNA as employed herein refers to short hairpin RNA which is a sequence of RNA that makes a tight hairpin turn that can be used to silence target gene expression via RNA interference (RNAi). miRNA (microRNA) as employed herein refers to a small non-coding RNA molecule (containing about 22 nucleotides) which functions, via base-pairing with complementary sequences within mRNA molecules, to regulate gene expression at the transcriptional or post-transcriptional level. mRNA strands bound by miRNA are silenced because they can no longer be translated into proteins by ribosomes, and such complexes are often actively disassembled by the cell.

In one embodiment, the transgene encodes a protein. Protein as employed herein includes a protein ligand, a protein receptor, or an antibody molecule.

Protein ligand as employed herein refers to cell surface membrane or secreted proteins binding fragments thereof, that bind to or otherwise engage with the cellular receptors to influence the function of the cell, for example by stimulating intracellular signalling and modulating gene transcription within the cell. In one embodiment the protein expressed is engineered to be expressed on the surface of the cell and/or secreted from the cell.

In one embodiment the protein encoded is a bi-specific antibody, such as a bispecific T-cell activator.

In one embodiment the transgene further encodes an enzyme, for example an enzyme that assists in degrading the extra-cellular matrix of the tumour, for example a DNAse, a collagenase, a matrix metalloproteinase (such as MMP2 or 14) or similar.

Suitable antibodies and antibody fragments may be agonistic or antagonistic and include those with anticancer activity and those which modify host cell responses to the cancer, for example: an agonist or antagonistic antibody or antibody fragment may decrease vascularization or normalise vascularization of the tumour. In one embodiment agonistic antibodies or other encoded proteins may render the host cell more visible to the host's innate and adaptive immune responses, for example by expressing antigens, danger signals, cytokines or chemokines to attract and activate the same, or by binding to co-stimulatory or checkpoint pathway molecules to enhance adaptive immune responses.

Therapeutic antibody or antibody-binding fragment as employed herein refers to antibody or antibody-binding fragment which, when inserted in to the oncolytic virus, has a beneficial impact on a pathology in the patient, for example on the cancer being treated.

Beneficial impact as employed herein refers to a desirable and/or advantageous effect of the antibody being expressed in vivo.

Classes of therapeutic antibodies and antibody-binding fragments include: anti-EGF antibodies, anti-VEGF antibodies, anti-PDGF antibodies, anti-CTLA antibodies, anti-PD1 antibodies, anti-PD L1 antibodies and anti-FGF antibodies.

Registered therapeutic antibodies suitable for incorporation into viruses of the present disclosure include: abciximab, adalimumab, alemtzumab, basiliximab, belimumab, bevacizumab, brentuximab vedotin, canakinumab, cetuximab, certolzumab, daclizumab, denosumab, eculzumab, efalixumab, gemtuzumab, golimumab, ibritumomab tiuxetan, infliximab, ipilimumab, muromonab-CD3, ofatumumab, palivizumab, panitumumab, ranibizumab, rituximab, tocilizumab, tositumomab and trastuzumab.

In one embodiment, the antibody variable region sequences of an antibody or antibody fragment employed are between 95 and 100% similar or identical to the variable regions of bevacizumab (also known as Avastin®), such as 96, 97, 98 or 99% similar or identical.

Also suitable for incorporation into viruses of the present disclosure are the coding sequences for those antibodies and binding fragments thereof which are approved for a cancer indications, for example trastuzumab, tositumomab, rituximab, panitumumab, ofatumumab, ipilimumab, ibritumomab tiuxetan, gemtuzumab, denosumab, cetuximab, brentuximab vedotin, avastin and adalimumab.

In one embodiment, the antibody variable region sequences of an antibody or antibody fragment employed are between 95 and 100% similar or identical to the variable regions of a known antibody or an antibody disclosed herein.

As used herein "antibody molecule" includes antibodies and binding fragments thereof.

Antibody as employed herein generally refers to a full length antibody and bispecific or multi-specific formats comprising the same.

Antibody-binding fragments includes an antibody fragment able to target the antigen with the same, similar or better specificity to the original "antibody" from which it was derived. Antibody fragments include: Fab, modified Fab, Fab', modified Fab', F(ab')$_2$, Fv, single domain antibodies (e.g. VH or VL or VHH), scFv, bi, tri or tetra-valent antibodies, Bis-scFv, diabodies, triabodies, tetrabodies and epitope-binding fragments of any of the above (see for example Holliger and Hudson, 2005, Nature Biotech. 23(9): 1126-1136; Adair and Lawson, 2005, Drug Design Reviews—Online 2(3), 209-217). The methods for creating and manufacturing these antibody fragments are well known in the art (see for example Verma et al., 1998, Journal of Immunological Methods, 216, 165-181). Other antibody fragments for use in the present invention include the Fab and Fab' fragments described in international patent applications WO2005/003169, WO2005/003170 and WO2005/003171. Multi-valent antibodies may comprise multiple specificities e.g. bispecific or may be monospecific (see for example WO 92/22853, WO05/113605, WO2009/040562 and WO2010/035012).

Specific as employed herein is intended to refer to an antibody or fragment that only recognises the antigen to which it is specific or to an antibody or fragment that has significantly higher binding affinity to the antigen to which is specific in comparison to its binding affinity to antigens to which it is not specific, for example 5, 6, 7, 8, 9, 10 times higher binding affinity.

Known antibodies or antibody-binding fragments can be employed to generate alternative antibody formats with the same CDRs or the same variable regions, for example, a full-length antibody can readily be converted into a Fab, Fab' or scFv fragment A wide range of different forms of antibody may be employed in constructs of the present disclosure including antibody molecules from non-human animals, human antibody molecules, humanised antibody molecules and chimeric antibody molecules.

In one embodiment, the antibody or binding fragment is monoclonal. Monoclonal antibodies may be prepared by any method known in the art such as the hybridoma technique (Kohler & Milstein, 1975, Nature, 256:495-497), the trioma technique, the human B-cell hybridoma technique (Kozbor et al., 1983, Immunology Today, 4:72) and the EBV-hybridoma technique (Cole et al., Monoclonal Antibodies and Cancer Therapy, pp 77-96, Alan R Liss, Inc., 1985).

In one embodiment, the antibody or binding fragment is non-human, i.e. completely from non-human origin. This is possible because the antibodies and fragments can be delivered inside the cancer cell by the virus.

In one embodiment the antibody is chimeric, for example has human constant region(s) and non-human variable regions.

In one embodiment, the antibody or binding fragment is human, i.e. from completely human origin.

In one embodiment, the antibody or binding fragment is humanised. Humanised antibodies (which include CDR-grafted antibodies) are antibody molecules having one or more complementarity determining regions (CDRs) from a non-human species and a framework region from a human immunoglobulin molecule (see, for example U.S. Pat. No. 5,585,089; WO91/09967). It will be appreciated that it may only be necessary to transfer the specificity determining residues of the CDRs rather than the entire CDR (see for example, Kashmiri et al., 2005, Methods, 36, 25-34). Humanised antibodies may optionally further comprise one or more framework residues derived from the non-human species, for example from which the CDRs were derived.

In one embodiment, the coding sequence encodes an antibody heavy chain an antibody light chain or an antibody fragment. Heavy chain (HC) as employed herein refers to the large polypeptide subunit of an antibody. Light chain (LC) as employed herein refers to the small polypeptide subunit of an antibody. In one embodiment, the antibody light chain comprises a CL domain, either kappa or lambda.

Antibodies for use in the present disclosure may be obtained using any suitable a method known in the art. The antigen polypeptide/protein including fusion proteins, including cells (recombinantly or naturally) expressing the polypeptide (such as activated T cells) can be used to produce antibodies which specifically recognise the antigen. The polypeptide may be the 'mature' polypeptide or a biologically active fragment or derivative thereof.

Screening for antibodies can be performed using assays to measure binding to antigen and/or assays to measure the ability to antagonise the receptor. An example of a binding assay is an ELISA, in particular, using a fusion protein (optionally comprising a reporter), which is immobilized on plates, and employing a conjugated secondary antibody to detect anti-antigen antibody bound to the fusion protein.

The constant region domains of the antibody molecule of the present invention, if present, may be selected having regard to the proposed function of the antibody molecule, and in particular the effector functions which may be required. For example, the constant region domains may be human IgA, IgD, IgE, IgG or IgM domains. In particular, human IgG constant region domains may be used, especially of the IgG1 and IgG3 isotypes when the antibody molecule is intended for therapeutic uses and antibody effector functions are required. Alternatively, IgG2 and IgG4 isotypes may be used when the antibody molecule is intended for therapeutic purposes and antibody effector functions are not required, e.g. for simply agonising activity or for target neutralization. It will be appreciated that sequence variants of these constant region domains may also be used. For example IgG4 molecules in which the serine at position 241 has been changed to proline as described in Angal et al., Molecular Immunology, 1993, 30 (1), 105-108 may be used.

For certain antibody functions, for example for delivering activation signals to cells bearing the antibody's target molecule, such as cells of the immune system, it may be advantageous to use membrane-anchored versions of the antibody such that the antibody will be expressed on the surface of the expressing cell. Such cell surface expressed binding molecules enable efficient multimeric interactions between the target signalling molecule on the surface of another cell which enhances delivery of activation signals from the target molecule into the recipient cell.

Advantageously, the adenoviruses of the present disclosure can express full length antibodies, antibody fragments such as scFvs, multispecific antibodies, in particular bispecific antibodies such as bispecific T-cell activators as described herein.

In one embodiment the sequence encoding the antibody or antibody fragment (such as a bispecific T-cell activator according to the present disclosure) comprise or further comprises an internal ribosome entry sequence. Internal ribosome entry sequence (IRES) as employed herein means a nucleotide sequence that allows for translation initiation in the middle of a messenger RNA (mRNA) sequence.

In one embodiment the encoded therapeutic proteins or peptides are target specific proteins, polypeptides or peptides.

Target specific proteins or peptides as employed herein refers to either the target proteins themselves, or different proteins or peptides that directly bind (for example are specific to the target) to or otherwise modify the levels of the target proteins or peptides. An example of the former would be a cytokine, whilst an example of the latter would be an antibody against that cytokine.

Targets of interest generally relate to particular cells, cellular products, antigens or signalling pathways associated with disease, particularly cancer. Target, depending on the context, also relates to mRNA or similar transcribed from the gene encoding the protein or polypeptide, which for example can be inhibited by RNAi type technology. Thus, in the context of RNA, such as RNAi technology the target is the mRNA which is encoded by the gene of the target.

Examples of targets of interest include, but are not limited to, stimulatory T-cell co-receptors and ligands thereto, checkpoint inhibitory T-cell co-receptor molecules and ligands thereto, receptors and ligands thereto expressed by regulatory T-cells, myeloid derived suppressor cells and immunosuppressive immune cells, dendritic cell and antigen-presenting cell receptors and ligands thereto, antigen processing and presentation mediators, cytokines and cytokine receptors, chemokines and chemokine receptors, transcription factors and regulators of transcription, intracellular trafficking molecules and regulators of cell function, tumour cell and tumour microenvironmental receptors and products, intracellular tumour cell enzymes such as IDO, antigens for recognition by immune cells.

Thus in one embodiment target as employed herein refers to a protein or polypeptide which can, for example be inhibited, neutralised or activated by, for example an antibody or binding fragment there, as appropriate. Target in the context of cytokines refers to a cytokine per se or an antibody or binding fragment thereof specific to the cytokine. Thus, the virus may encode and express the cytokine itself as release of thereof may stimulate "host" immune responses. In the context of ligands, mutated forms of the ligand can be encoded by the virus which compete with the natural ligand to bind the receptor. The mutated ligand may have increased binding affinity for the receptor, for example such that it has a slow off-rate thereby occupying the receptor and increasing or decreasing signalling therefrom. Alternatively, the activity of the mutated ligand may be reduced in comparison to the wild-type ligand, thereby reducing the binding and overall activity through the receptor from the natural ligand.

In one embodiment, the virus or construct according to the present disclosure encodes a pro-drug, an immunomodulator and/or an enzyme.

Pro-drug as employed herein means a molecule that is administered as an inactive (or less than fully active) derivative that is subsequently converted to an active pharmacological agent in the body, often through normal metabolic processes. A pro-drug serves as a type of precursor to the intended drug. A pro-drug converting enzyme serves as the enzyme that converts a pro-drug to its pharmacologically active form.

Immunomodulator as employed herein means a modulator of immune response. Immunomodulators function in adjustment of the immune response to a desired level, as in immunopotentiation, immunosuppression, or induction of immunologic tolerance.

T cells require two signals to become fully activated. A first signal, which is antigen-specific, is provided through the T cell receptor which interacts with peptide-MHC molecules on the membrane of antigen presenting cells (APC). A second signal, the co-stimulatory signal, is antigen non-specific and is provided by the interaction between co-stimulatory molecules expressed on the membrane of APC and the T cell. Thus, co-stimulatory molecule as employed herein means a molecule that provides a complementary signal to the antigen-specific signal required by T cells for activation, proliferation and survival. Examples of co-stimulatory molecules include but are not limited to CD28, CD80, CD86, CD83 and 4-1BB.

Enzyme as employed herein means a substance that acts as a catalyst in living organisms, regulating the rate at which chemical reactions proceed without itself being altered in the process.

The following is a non-exhaustive discussion of exemplary target peptides/polypeptides and proteins.

In one embodiment the target is a checkpoint protein, such as an immune checkpoint or cell cycle checkpoint protein. Examples of checkpoint proteins include but are not limited to: CTLA-4, PD-1, PD-L1, PD-L2, VISTA, B7-H3, B7-H4, HVEM, ILT-2, ILT-3, ILT-4, TIM-3, LAG-3, BTLA, LIGHT or CD160, for example CTLA-4, PD-1, PD-L1 and PD-L2. In one embodiment there is provided an antibody or binding fragment thereof which is specific to one of the same. Thus in one embodiment a transgene or transgene cassette encodes an antibody or antibody fragment specific to CTLA-4, PD-1, PD-L1 or PD-L2. In one embodiment, the adenovirus expresses an antibody or antibody fragment specific to CTLA-4, PD-1, PD-L1 or PD-L2.

In one embodiment, the antibody is a checkpoint inhibitor antibody, for example anti-PD-L1. In one embodiment, the adenovirus expresses full length anti-human PD-L1 antibody. In one embodiment, the expression of full length anti-human PD-L1 antibody is under the control of an endogenous promoter, such as the major late promoter (MLP), in particular in position $B_Y$. In one embodiment, the adenovirus expresses the scFv form of anti-human PD-L1 antibody. In one embodiment, the expression of a scFv form of anti-human PD-L1 antibody is under the control of an endogenous promoter, such as the Major late promoter, in particular in position $B_Y$.

In one embodiment, there is provided a virus or construct according to the present disclosure encoding an antibody or binding fragment thereof, for a full-length antibody or scFv specific to CTLA-4, for example as exemplified herein.

In one embodiment the target, is one or more independently selected from the group comprising CD16, CD25, CD33, CD332, CD127, CD31, CD43, CD44, CD162, CD301a, CD301b and Galectin-3. In one embodiment, there is provided an antibody or binding fragment thereof specific thereto, for example a full-length antibody or a scFv.

In one embodiment the target, for example which may be targeted by an antibody or binding fragment, is one or more independently selected from the group comprising: FLT-3, FLT-3 ligand, TLRs, ligands, CCR7, CD1a, CD1c, CD11b, CD11c, CD80, CD83, CD86, CD123, CD172a, CD205, CD207, CD209, CD273, CD281, CD283, CD286, CD289, CD287, CXCR4, GITR Ligand, IFN-α2, IL-12, IL-23, ILT1, ILT2, ILT3, ILT4, ILT5, ILT7, TSLP Receptor, CD141, CD303, CADM1, CLEC9a, XCR1 and CD304.

In one embodiment the target, of a bispecific T-cell activator employed in the present disclosure, is a tumour cell antigen.

In one embodiment, the target is one or more independently selected from the group comprising: CEA, MUC-1, EpCAM, HER receptors HER1, HER2, HER3, HER4, PEM, A33, G250, carbohydrate antigens $Le^y$, $Le^x$, $Le^b$, PSMA, TAG-72, STEAP1, CD166, CD24, CD44, E-cadherin, SPARC, ErbB2, ErbB3.

In one embodiment the target, of a bispecific T-cell activator employed in the present disclosure, is a tumour stroma antigen.

In one embodiment, the target of a bispecific T-cell activator employed in the present disclosure is one or more independently selected from the group comprising: FAP, TREM1, IGFBP7, FSP-1, platelet-derived growth factor-α receptor (PDGFR-α), platelet-derived growth factor-β receptor (PDGFR-β) and vimentin.

In one embodiment the target, for example which may be targeted by an antibody or binding fragment (such as a bispecific T-cell activator), is a cancer target.

In one embodiment, the target is one or more independently selected from the group comprising: OX40, OX40 ligand, CD27, CD28, CD30, CD40, CD40 ligand, TL1A, CD70, CD137, GITR, 4-1BB, ICOS or ICOS ligand, for example CD40 and CD40 ligand.

In one embodiment the transgene cassette encodes a ligand comprising CD40 or CD40 ligand, or an antibody, antibody fragment or shRNA targeted to CD40 or CD40 ligand. In one embodiment the adenovirus expresses a ligand comprising CD40 or CD40 ligand, or an antibody, antibody fragment or shRNA targeted to (specific to) CD40 or CD40 ligand.

In one embodiment the target is one or more cytokines independently selected from the group comprising: IL-1α, IL-1β, IL-6, IL-9, IL-12, IL-13, IL-17, IL-18, IL-22, IL-23, IL-24, IL-25, IL-26, IL-27, IL-33, IL-35. Interleukin-2 (IL-2), IL-4, IL-5, IL-7, IL-10, IL-15, IL-21, IL-25, IL-1RA, IFNα, IFNβ, IFNγ, TNFα, TGFβ, lymphotoxin α (LTA) and GM-CSF.

In one embodiment the transgene cassette encodes an antibody or antibody fragment specific to IL-12, IL-18, IL-22, IL-7, IL-15, IL-21, IFNα, IFNγ, TNFα, TGFβ or lymphotoxin α (LTA). In one embodiment the adenovirus expresses IL-12, IL-18, IL-22, IL-7, IL-15, IL-21, IFNα, IFNγ, TNFα, TGFβ or lymphotoxin α (LTA).

In one embodiment, the amino acid sequence of IFNγ is SEQ ID NO: 68. In one embodiment the amino acid sequence of IFNα is SEQ ID NO: 69. In one embodiment the amino acid sequence of TNFα is SEQ ID NO: 70.

In one embodiment, the target is a chemokine, for example one or more independently selected from the group comprising: IL-8, CCL3, CCL5, CCL17, CCL20, CCL22, CXCL9, CXCL10, CXCL11, CXCL13, CXCL12, CCL2, CCL19, CCL21, CXCR2, CCR2, CCR4, CCR5, CCR6, CCR7, CCR8, CXCR3, CXCR4, CXCR5 and CRTH2.

In one embodiment, the transgene cassette encodes an antibody or antibody fragment specific to CCL5, CXCL9, CXCL12, CCL2, CCL19, CCL21, CXCR2, CCR2, CCR4 or CXCR4. In the context of the chemokines target includes where the viruses encodes and expresses the chemokine, for example to induce or augment host immune responses to the cancer.

In one embodiment, the adenovirus expresses an antibody or antibody fragment specific to CCL5, CXCL9, CXCL12, CCL2, CCL19, CCL21, CXCR2, CCR2, CCR4 or CXCR4.

In one embodiment, the target is one or more independently selected from the group comprising: STAT3, STAT1, STAT4, STATE, CTIIA, MyD88 and NFκB family members, for example the protein is targeted with an inhibitor, for example an antibody or bind fragment thereof, or mRNA transcribed from the relevant gene is inhibited by a mechanism, such as RNAi.

In one embodiment, the target is HSp70 or a regulator of cell survival and death such as survivin, for example the protein is targeted with an inhibitor, for example an antibody or bind fragment thereof, or mRNA transcribed from the relevant gene is inhibited by a mechanism, such as RNAi.

In one embodiment, the target is one or more independently selected from the group comprising: amphiregulin, BTC, NRG1a, NRG1b, NRG3, TGFα, LRIG1, LRIG3, EGF, EGF-L6, Epigen, HB-EGF, EGFR, Her2, Her3 and Her4, for example the protein is targeted with an inhibitor, for example an antibody or bind fragment thereof, or mRNA transcribed from the relevant gene is inhibited by a mechanism, such as RNAi.

In one embodiment, the target is a ligand or receptor for one or more independently selected from the group comprising: hedgehog, FGF, IGF, Wnt, VEGF, TNF, TGFβ, PDGF and Notch.

In one embodiment the adenovirus expresses an antibody or antibody fragment specific to VEGF. In one embodiment the antibody is an anti-VEGF antibody. For example, such as an antibody having the amino acid sequence of the antibody Bevacizumab or equivalent thereto. In one embodiment the adenovirus expresses full length anti-human VEGF antibody. In one embodiment, the expression of full length anti-human VEGF antibody is under the control of an endogenous promoter, such as the Major late promoter (MLP), in particular in position $B_Y$. In one embodiment, the adenovirus expresses the scFv form of anti-human VEGF antibody. In one embodiment, the expression of the scFv form of anti-human VEGF antibody is under the control of an endogenous promoter, such as the Major late promoter, in particular in position $B_Y$.

In one embodiment, the target is ID0.

In one embodiment the target is an antigen for recognition by immune cells (such as a T cell engaged by a bispecific T-cell activator) is one or more proteins or peptides independently selected from the group comprising: immunogenic proteins from infectious organisms, such as cytomegalovirus antigens, influenza antigens, hepatitis B surface and core antigens, diphtheria toxoid, Crm197, tetanus toxoid; peptides derived from such antigens which are known T-cell or antibody epitopes, or genetically engineered composites or multimers of such antigens; tumour-derived proteins as antigens; peptides derived from such antigens which are known T-cell or antibody epitopes; and genetically engineered composites or multimers of such antigens for example WT1, MUC1, LMP2, idiotype, HPV E6&E7, EGFRvIII, HER-2/neu, MAGE A3, p53 nonmutant, p53 mutant, NY-ESO-1, GD2, PSMA, PCSA, PSA, gp100, CEA, MelanA/MART1, Ras mutant, proteinase3 (PR1), bcr-abl, tyrosinase, survivin, PSA, hTERT, particularly WT1, MUC1, HER-2/neu, NY-ESO-1, survivin or hTERT.

The skilled person will appreciate that many possibilities exist for nucleic acid sequences that encode a given amino acid sequence due to codon redundancy, that silent nucleic acid base pair mutations are tolerated and all nucleic acid sequences that encode a given amino acid sequence as defined in any of the SEQ ID NO's are envisioned by the present disclosure.

In one embodiment the peptide, polypeptide or protein encoded by a transgene is a mimotope. As employed herein a mimotope is a molecule, often a peptide, which mimics the structure of an epitope. The latter property causes an antibody response similar to the one elicited by the epitope. An antibody for a given epitope antigen will recognize a mimotope which mimics that epitope. Mimotopes are commonly obtained from phage display libraries through biopanning. Vaccines utilizing mimotopes are being developed. Thus antibodies of known specificity may be used to screen libraries (e.g peptide libraries in phage display—for example Ab sequence libraries or non-antibody peptide libraries, particularly those optimized for producing peptides with more stable 3D conformations)—Generation of mimotopes is well described in the art (see Tribbick G, Rodda S. Combinatorial methods for discovery of peptide ligands which bind to antibody-like molecules. J Mol Recognit 2002 15(5):306-10; Masuko T, Ohno Y, Masuko K, Yagi H, Uejima S, Takechi M, Hashimoto Y. Towards therapeutic antibodies to membrane oncoproteins by a robust strategy using rats immunized with transfectants expressing target molecules fused to green fluorescent protein. Cancer Sci. 2011 102 (1):25-35).

In one embodiment, a mimotope or other designed vaccine antigens are encoded by a transgene and expressed in order to induce an antibody response in the recipient patient, wherein the antibodies induced have the desired therapeutic effect. In one embodiment GFP-peptide fusion proteins, with peptide sequences from desired human ligand, are used to induce anti-self target antibody responses, for example a peptide region of PD-L1 that is known to be important for binding to target molecule PD-1 may be genetically linked with GFP or other highly immunogenic foreign carrier proteins such that an immune antibody response to the peptide includes antibodies that cross-react with the native PDL1 molecule and thus serve to block PD-L1: PD-1 interactions in the same way as directly encoding an anti-PDL1 antibody would. Concepts for vaccines inducing ant-self therapeutic antibody responses are well described in the art (see Spohn G, Bachmann M F. Therapeutic vaccination to block receptor-ligand interactions. Expert Opin Biol Ther. 2003 3(3):469-76; Link A, Bachmann M F. Immunodrugs: breaking B- but not T-cell tolerance with therapeutic anticytokine vaccines. Immunotherapy 2010 2(4):561-74; Delavallée L, Assier E, Semerano L, Bessis N, Boissier M C. Emerging applications of anticytokine vaccines. Expert Rev Vaccines. 2008 7(10):1507-17).

In one or more embodiments, the transgene employed encodes a sequence shown in any one of SEQ ID NOs: 2, 4, 7, 11 or 16.

In another embodiment, the transgene employed encodes a sequence which excludes the deca-His affinity tag at the C-terminal end for example as shown in a virus set forth in any one of SEQ ID NOs: 72 to 78.

Advantageously adenoviruses of the present disclosure express and release antibody forms (such as a bispecific T-cell activator) and other proteins, such as cytokines, encoded by a transgene therein into the culture supernatant in vitro or into tumour tissue stroma in vivo. Leader sequences may assist the encoded proteins/polypeptide or peptide exiting the cancer cell. Therefore, in one embodiment the encoded "protein" comprises a leader sequence. Leader sequence as employed herein refers to a polynucleotide sequence located between the promoter sequence and the coding region which can regulate gene expression at the level of transcription or translation.

In one embodiment the coding sequence encodes a peptide. Peptide as employed herein refers to an amino acid chain which is nota complete functional protein. Typically, a fragment which retains some or all of the function of the protein that it is a fragment of, or can be recognized by the immune system, for example peptides of 8 or more amino acids that can be recognized by T-cells.

In one embodiment, the transgene is a reporter gene encoding, for example an imaging agent including bioluminescent, fluorescent imaging agents (including activatable fluorescent imaging agents), such as luciferase, GFP or eGFP or red fluorescent protein.

Reporter gene or reporter sequence as employed herein means a gene or DNA sequence that produces a product easily detected in eukaryotic cells and may be used as a marker to determine the activity of another gene with which its DNA has been closely linked or combined. Reporter genes confer characteristics on cells or organisms expressing them that are easily identified and measured, or are selectable markers. Reporter genes are often used as an indication of whether a certain gene has been taken up by or expressed in the cell or organism population. Examples of common reporter genes include, but are not limited to, LacZ, luciferase, GFP, eGFP, neomycin phosphotransferase, chloramphenicol acetyltransferase, sodium iodide symporter (NIS), nitroreductase (e.g. NfsA, NfsB) intracellular metalloproteins, HSV1-tk or oestrogen receptor.

In one embodiment the genetic material (in particular the transgene) does not encode or express a reporter gene such as an imaging agent, luciferase, GFP or eGFP.

Viruses according to the present disclosure can be investigated for their preference for a specific tumour type by examination of its lytic potential in a panel of tumour cells, for example colon tumour cell lines include HT-29, DLD-1, LS174T, LS1034, SW403, HCT116, SW48, and Colo320DM. Any available colon tumour cell lines would be equally useful for such an evaluation.

Prostate cell lines include DU145 and PC-3 cells. Pancreatic cell lines include Panc-1 cells. Breast tumour cell lines include MDA231 cell line and ovarian cell lines include the OVCAR-3 cell line. Hemopoietic cell lines include, but are not limited to, the Raji and Daudi B-lymphoid cells, K562 erythroblastoid cells, U937 myeloid cells, and HSB2 T-lymphoid cells. Other available tumour cell lines are equally useful.

The present disclosure also extends to novel sequences disclosed herein. In one embodiment the virus is shown in any one of sequences disclosed herein, for example any one of SEQ ID NOs: 34 to 37 or a sequence at least 95% identical thereto, for example as set forth in any one of SEQ ID NOs: 79 to 82.

Formulations

The present disclosure relates also extends to a pharmaceutical formulation of a virus as described herein.

In one embodiment there is provided a liquid parenteral formulation, for example for infusion or injection, of a replication capable oncolytic according to the present disclosure wherein the formulation provides a dose in the range of $1\times10^{10}$ to $1\times10^{14}$ viral particles per volume of dose.

Parenteral formulation means a formulation designed not to be delivered through the GI tract Typical parenteral delivery routes include injection, implantation or infusion. In one embodiment the formulation is provided in a form for bolus delivery.

In one embodiment the parenteral formulation is in the form of an injection. Injection includes intravenous, subcutaneous, intra-tumoural or intramuscular injection. Injection as employed herein means the insertion of liquid into the body via a syringe. In one embodiment, the method of the present disclosure does not involve intra-tumoural injection.

In one embodiment the parenteral formulation is in the form of an infusion.

Infusion as employed herein means the administration of fluids at a slower rate by drip, infusion pump, syringe driver or equivalent device. In one embodiment, the infusion is administered over a period in the range of 1.5 minutes to 120 minutes, such as about 3, 4, 5, 6, 7, 8, 9, 10, 11, 12, 13, 14 15, 16, 17, 18, 19 20, 25, 30, 35, 40, 45, 50, 55, 60, 65, 70, 65, 80, 85, 90, 95, 100, 105, 110 or 115 minutes.

In one embodiment one dose of the formulation less than 100 mls, for example 30 mls, such as administered by a syringe driver. In one embodiment one dose of the formulation is less than 10 mls, for example 9, 8, 7, 6, 5, 4, 3, 2 or 1 mls. In one embodiment one dose of the formulation is less than 1 ml, such as 0.9, 0.8, 0.7, 0.6, 0.5, 0.4, 0.3, 0.2 or 0.1 mls.

In one embodiment, the injection is administered as a slow injection, for example over a period of 1.5 to 30 minutes.

In one embodiment, the formulation is for intravenous (i.v.) administration. This route is particularly effective for delivery of oncolytic virus because it allows rapid access to the majority of the organs and tissue and is particular useful for the treatment of metastases, for example established metastases especially those located in highly vascularised regions such as the liver and lungs.

Therapeutic formulations typically will be sterile and stable under the conditions of manufacture and storage. The composition can be formulated as a solution, microemulsion, liposome, or other parenteral formulation suitable for administration to a human and may be formulated as a pre-filled device such as a syringe or vial, particular as a single dose.

The formulation will generally comprise a pharmaceutically acceptable diluent or carrier, for example a non-toxic, isotonic carrier that is compatible with the virus, and in which the virus is stable for the requisite period of time.

The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a dispersant or surfactant such as lecithin or a non-ionic surfactant such as polysorbate 80 or 40. In dispersions the maintenance of the required particle size may be assisted by the presence of a surfactant. Examples of isotonic agents include sugars, polyalcohols such as mannitol, sorbitol, or sodium chloride in the composition.

In one embodiment, parenteral formulations employed may comprise one or more of the following a buffer, for example 4-(2-hydroxyethyl)-1-piperazineethanesulfonic acid, a phosphate buffer and/or a Tris buffer, a sugar for example dextrose, mannose, sucrose or similar, a salt such as sodium chloride, magnesium chloride or potassium chloride, a detergent such as a non-ionic surfactant such as briji, PS-80, PS-40 or similar. The formulation may also comprise a preservative such as EDTA or ethanol or a combination of EDTA and ethanol, which are thought to prevent one or more pathways of possible degradation.

In one embodiment, the formulation will comprise purified oncolytic virus according to the present disclosure, for example $1\times10^{18}$ to $1\times10^{14}$ viral particles per dose, such as $1\times10^{18}$ to $1\times10^{12}$ viral particles per dose. In one embodiment the concentration of virus in the formulation is in the range $2\times10^{8}$ to $2\times10^{14}$ vp/mL, such as $2\times10^{12}$ vp/ml.

In one embodiment, the parenteral formulation comprises glycerol.

In one embodiment, the formulation comprises oncolytic adenovirus as described herein, HEPES (N-2-hydroxyethylpiperazine-N'-2-ethanesulfonic acid), glycerol and buffer.

In one embodiment, the parenteral formulation consists of virus of the disclosure, HEPES for example 5 mM, glycerol for example 5-20% (v/v), hydrochloric acid, for example to adjust the pH into the range 7-8 and water for injection.

In one embodiment 0.7 mL of virus of the disclosure at a concentration of $2\times10^{12}$ vp/mL is formulated in 5 mM HEPES, 20% glycerol with a final pH of 7.8.

A thorough discussion of pharmaceutically acceptable carriers is available in Remington's Pharmaceutical Sciences (Mack Publishing Company, N.J. 1991).

In one embodiment, the formulation is provided as a formulation for topical administrations including inhalation.

Suitable inhalable preparations include inhalable powders, metering aerosols containing propellant gases or inhalable solutions free from propellant gases. Inhalable powders according to the disclosure will generally contain a virus as described herein with a physiologically acceptable excipient.

These inhalable powders may include monosaccharides (e.g. glucose or arabinose), disaccharides (e.g. lactose, saccharose, maltose), oligo- and polysaccharides (e.g. dextranes), polyalcohols (e.g. sorbitol, mannitol, xylitol), salts (e.g. sodium chloride, calcium carbonate) or mixtures of these with one another. Mono- or disaccharides are suitably used, the use of lactose or glucose, particularly but not exclusively in the form of their hydrates.

Particles for deposition in the lung require a particle size less than 10 microns, such as 1-9 microns for example from 0.1 to 5 μm, in particular from 1 to 5 μm. The particle size of the carrying the virus is of primary importance and thus in one embodiment the virus according to the present disclosure may be adsorbed or absorbed onto a particle, such as a lactose particle of the given size.

The propellant gases which can be used to prepare the inhalable aerosols are known in the art. Suitable propellant gases are selected from among hydrocarbons such as n-propane, n-butane or isobutane and halohydrocarbons such as chlorinated and/or fluorinated derivatives of methane, ethane, propane, butane, cyclopropane or cyclobutane. The above-mentioned propellant gases may be used on their own or in mixtures thereof.

Particularly suitable propellant gases are halogenated alkane derivatives selected from among TG 11, TG 12, TG 134a and TG227. Of the abovementioned halogenated hydrocarbons, TG134a (1,1,1,2-tetrafluoroethane) and TG227 (1,1,1,2,3,3,3-heptafluoropropane) and mixtures thereof are particularly suitable.

The propellant gas-containing inhalable aerosols may also contain other ingredients, such as cosolvents, stabilisers, surface-active agents (surfactants), antioxidants, lubricants and means for adjusting the pH. All these ingredients are known in the art. The propellant gas-containing inhalable aerosols according to the invention may contain up to 5% by weight of active substance. Aerosols according to the invention contain, for example, 0.002 to 5% by weight, 0.01 to 3% by weight, 0.015 to 2% by weight, 0.1 to 2% by weight, 0.5 to 2% by weight or 0.5 to 1% by weight of active ingredient.

Alternatively topical administrations to the lung may also be by administration of a liquid solution or suspension formulation, for example employing a device such as a nebulizer, for example, a nebulizer connected to a compressor (e.g., the Pari LC-Jet Plus® nebulizer connected to a Pari Master® compressor manufactured by Pari Respiratory Equipment, Inc., Richmond, Va.).

The virus of the invention can be delivered dispersed in a solvent, e.g. in the form of a solution or a suspension, for example as already described above for parenteral formulations. It can be suspended in an appropriate physiological solution, e.g., saline or other pharmacologically acceptable solvent or a buffered solution. Buffered solutions known in the art may contain 0.05 mg to 0.15 mg disodium edetate, 8.0 mg to 9.0 mg NaCl, 0.15 mg to 0.25 mg polysorbate, 0.25 mg to 0.30 mg anhydrous citric acid, and 0.45 mg to 0.55 mg sodium citrate per 1 ml of water so as to achieve a pH of about 4.0 to 5.0.

The therapeutic suspensions or solution formulations can also contain one or more excipients. Excipients are well known in the art and include buffers (e.g., citrate buffer, phosphate buffer, acetate buffer and bicarbonate buffer), amino acids, urea, alcohols, ascorbic acid, phospholipids, proteins (e.g., serum albumin), EDTA, sodium chloride, liposomes, mannitol, sorbitol, and glycerol. Solutions or suspensions can be encapsulated in liposomes or biodegradable microspheres. The formulation will generally be provided in a substantially sterile form employing sterile manufacture processes.

This may include production and sterilization by filtration of the buffered solvent/solution used for the formulation, aseptic suspension of the antibody in the sterile buffered solvent solution and dispensing of the formulation into sterile receptacles by methods familiar to those of ordinary skill in the art.

Nebulisable formulation according to the present disclosure may be provided, for example, as single dose units (e.g., sealed plastic containers or vials) packed in foil envelopes. Each vial contains a unit dose in a volume, e.g., 2 mL, of solvent/solution buffer.

Treatment

In a further aspect, the present disclosure extends to a virus or a formulation thereof as described herein for use in treatment, in particular for the treatment of cancer.

In one embodiment, the method of treatment is for use in the treatment of a tumour, in particular a solid tumour.

Tumour as employed herein is intended to refer to an abnormal mass of tissue that results from excessive cell division that is uncontrolled and progressive, also called a neoplasm. Tumours may be either benign (not cancerous) or malignant Tumour encompasses all forms of cancer and metastases.

In one embodiment, the tumour is a solid tumour. The solid tumour may be localised or metastasised.

In one embodiment, the tumour is of epithelial origin.

In one embodiment, the tumour is a malignancy, such as colorectal cancer, hepatoma, prostate cancer, pancreatic cancer, breast cancer, ovarian cancer, thyroid cancer, renal cancer, bladder cancer, head and neck cancer or lung cancer.

In one embodiment, the tumour is a colorectal malignancy.

Malignancy as employed herein means cancerous cells.

In one embodiment, the oncolytic adenovirus is employed in the treatment or prevention of metastasis.

In one embodiment, the method or formulation herein is employed in the treatment of drug resistant cancers.

In one embodiment, the virus is administered in combination with the administration of a further cancer treatment or therapy.

In one embodiment, there is provided a virus or formulation according to the present disclosure for use in the manufacture of a medicament for the treatment of cancer, for example a cancer described above.

In a further aspect, there is provide a method of treating cancer comprising administering a therapeutically effective amount of a virus or formulation according to the present disclosure to a patient in need thereof, for example a human patient.

In one embodiment, the oncolytic virus or formulation herein is administered in combination with another therapy.

"In combination" as employed herein is intended to encompass where the oncolytic virus is administered before, concurrently and/or post cancer treatment or therapy.

Cancer therapy includes surgery, radiation therapy, targeted therapy and/or chemotherapy. Cancer treatment as employed herein refers to treatment with a therapeutic compound or biological agent, for example an antibody intended to treat the cancer and/or maintenance therapy thereof.

In one embodiment, the cancer treatment is selected from any other anti-cancer therapy including a chemotherapeutic agent, a targeted anticancer agent, radiotherapy, radio-isotope therapy or any combination thereof.

In one embodiment, the virus of the present disclosure such as an oncolytic adenovirus may be used as a pre-treatment to the therapy, such as a surgery (neoadjuvant therapy), to shrink the tumour, to treat metastasis and/or prevent metastasis or further metastasis. The oncolytic adenovirus may be used after the therapy, such as a surgery (adjuvant therapy), to treat metastasis and/or prevent metastasis or further metastasis.

Concurrently as employed herein is the administration of the additional cancer treatment at the same time or approximately the same time as the oncolytic adenovirus formulation. The treatment may be contained within the same formulation or administered as a separate formulation.

In one embodiment, the virus is administered in combination with the administration of a chemotherapeutic agent.

Chemotherapeutic agent as employed herein is intended to refer to specific antineoplastic chemical agents or drugs that are selectively destructive to malignant cells and tissues. For example, alkylating agents, antimetabolites, anthracyclines, plant alkaloids, topoisomerase inhibitors, and other antitumour agents. Other examples of chemotherapy include doxorubicin, 5-fluorouracil (5-FU), paclitaxel, capecitabine, irinotecan, and platins such as cisplatin and oxaliplatin. The preferred dose may be chosen by the practitioner based on the nature of the cancer being treated.

In one embodiment the therapeutic agent is ganciclovir, which may assist in controlling immune responses and/or tumour vascularisation.

In one embodiment one or more therapies employed in the method herein are metronomic, that is a continuous or frequent treatment with low doses of anticancer drugs, often given concomitant with other methods of therapy.

Subgroup B oncolytic adenoviruses, in particular Ad11 and those derived therefrom such as EnAd may be particularly synergistic with chemotherapeutics because they seem to have a mechanism of action that is largely independent of apoptosis, killing cancer cells by a predominantly necrolytic mechanism. Moreover, the immunosuppression that occurs during chemotherapy may allow the oncolytic virus to function with greater efficiency.

Therapeutic dose as employed herein refers to the amount of virus, such as oncolytic adenovirus that is suitable for achieving the intended therapeutic effect when employed in a suitable treatment regimen, for example ameliorates symptoms or conditions of a disease. A dose may be considered a therapeutic dose in the treatment of cancer or metastases when the number of viral particles may be sufficient to result in the following: tumour or metastatic growth is slowed or stopped, or the tumour or metastasis is found to shrink in size, and/or the life span of the patient is extended. Suitable therapeutic doses are generally a balance between therapeutic effect and tolerable toxicity, for example where the side-effect and toxicity are tolerable given the benefit achieved by the therapy.

In one embodiment, a virus or therapeutic construct according to the present disclosure (including a formulation comprising same) is administered weekly, for example one week 1 the dose is administered on day 1, 3, 5, followed by one dose each subsequent week.

In one embodiment, a virus or therapeutic construct according to the present disclosure (including a formulation comprising same) is administered bi-weekly or tri-weekly, for example is administered in week 1 one on days 1, 3 and 5, and on week 2 or 3 is also administered on days 1, 3 and 5 thereof. This dosing regimen may be repeated as many times as appropriate.

In one embodiment, a virus or therapeutic construct according to the present disclosure (including a formulation comprising same) is administered monthly.

In one embodiment, the viruses and constructs of the present disclosure are prepared by recombinant techniques. The skilled person will appreciate that the armed adenovirus genome can be manufactured by other technical means, including entirely synthesising the genome or a plasmid comprising part of all of the genome. The skilled person will appreciate that in the event of synthesising the genome the region of insertion may not comprise the restriction site nucleotides as the latter are artefacts following insertion of genes using cloning methods.

In one embodiment the armed adenovirus genome is entirely synthetically manufactured, for example as per SEQ ID NOs: 34 to 37.

The disclosure herein further extends to an adenovirus of formula (I) or a subformula thereof, obtained or obtainable from inserting a transgene or transgene cassette.

"Is" as employed herein means comprising.

In the context of this specification "comprising" is to be interpreted as "including". Embodiments of the invention comprising certain features/elements are also intended to extend to alternative embodiments "consisting" or "consisting essentially" of the relevant elements/features.

Where technically appropriate, embodiments of the invention may be combined.

Technical references such as patents and applications are incorporated herein by reference.

Any embodiments specifically and explicitly recited herein may form the basis of a disclaimer either alone or in combination with one or more further embodiments.

The present application claims priority from GB1614607.8, GB1700663.6, GB1706219.1 and GB1713765.4 incorporated herein by reference. These documents may be employed to correct errors in the present specification, in particular an error in the sequence listing.

The present invention is further described by way of illustration only in the following examples, which refer to the accompanying Figures, in which:

DESCRIPTION OF THE FIGURES

FIG. 1 (A) schematic representation of a bispecific T-cell activator antibody of the present disclosure comprising or lacking an optional decahistidine affinity tag. Ig SP: signal peptide; 10His: decahistidine affinity tag; L: GS linker; V L: variable light domain; V H variable heavy domain. (B) plasmid map for pSF-CMV-EpCAMbispecific T-cell activator. (C) plasmid map for pSF-CMV-FAPbispecific T-cell activator. (D) plasmid map for pSF-CMV-Controlbispecific T-cell activator.

FIG. 2 (A) dot blot showing the quantification of the recombinant bispecific T-cell activators. (B) shows a graph showing the ELISA results for FAP. (C) graph showing the ELISA results for EpCAM.

FIG. 3 shows a graph showing the expression levels of CD69 (A) and CD25 (B) for T cells co-cultured alone or with NHDF cells in the presence of FAP bispecific T-cell activators and control bispecific T-cell activators measured using flow cytometry.

FIG. 4 (A) graph showing the levels of IFN γ expression for T cells co-cultured alone or with NHDF cells in the presence of FAP bispecific T-cell activators and control bispecific T-cell activators measured by intracellular cytokine staining. Graphs (B) & (C) show the expression levels of CD69 and CD25 for T cells co-cultured alone or with DLD cells in the presence of EpCAM bispecific T-cell activators and control bispecific T-cell activators measured using flow cytometry.

FIG. 5 (A) graph showing the levels of IFN γ expression for T cells co-cultured with DLD cells in the presence of EpCAM bispecific T-cell activators and control bispecific T-cell activators measured by intracellular cytokine staining. Graphs (B) & (C) showing the levels of CD69 and CD25 for PBMCs co-cultured with DLD cells in the presence of EpCAM bispecific T-cell activators and control bispecific T-cell activators measured by flow cytometry.

FIGS. 7A and 7B (7A) scatter plots showing FAP expression in multiple patient-derived cells. (7B) graph showing the % of cells expressing EpCAM and FAP across multiple cells and cell lines.

FIG. 9 (A) graph showing the results of a LDH assay showing the cytoxicity of SKOV cells which have been co-cultured with T cells and EpCAM bispecific T-cell activators or control bispecific T-cell activators. (B) graph showing the results of a LDH assay showing the cytoxicity of MCF7 cells which have been co-cultured with T cells and EpCAM bispecific T-cell activators or control bispecific T-cell activators.

FIG. 12 shows a graph showing T-cell activation (based on CD69 and CD25 expression levels) by CHO vs CHO-FAP cells, analysed using flow cytometry.

FIG. 13 (A) graphs showing EpCAM expression of the parental cell lines vs stable transfected variant determined by staining with EpCAM or isotope control antibody and analysed using flow cytometry. (B) graph showing the results of a LDH assay showing the cytoxicity of CHO or CHO-EpCAM cells which have been co-cultured with T cells and EpCAM bispecific T-cell activators or control bispecific T-cell activators.

FIG. 14 shows graph showing T-cell activation (based on CD69 and CD25 expression levels) by CHO vs CHO-EpCAM cells, analysed using flow cytometry.

FIG. 16 (A) graph showing CD4+ and CD8+ T-cell activation (based on CD69 and CD25 expression levels) by DLD cells in the presence of EpCAM or control bispecific T-cell activators analysed using flow cytometry. (B) graph showing the results of a LDH assay showing the cytoxicity of DLD cells which have been co-cultured with CD4+ or CD8+ T cells and EpCAM bispecific T-cell activators or control bispecific T-cell activators.

FIG. 21 shows graphs showing the results of experiments to determine the quantity of FAP bispecific T-cell activators produced from NG-605 and NG-606.

FIG. 29 shows still frame images from timelapse videos of lysis of NHDF cells by NG-607, NG-608, NG-609 or NG-610.

FIG. 39 shows microscopy images of ascites cells obtained from a patient, infected with viruses of the present disclosure and stained with EnAd-CMV-GFP and EnAd-SA-GFP as a reporters to determine infection and late stage viral gene expression.

FIG. 41 shows microscopy images of ascites cells obtained from a cancer patient, infected with viruses of the present disclosure and stained with EnAd-CMV-GFP and EnAd-SA-GFP as a reporters to determine infection and late stage viral gene expression.

FIG. 46 Characterisation of recombinant EpCAM Bispecific T-cell Activator
- (A) Dot blot to estimate the quantity of EpCAM bispecific T-cell activators produced by transfected HEK293A cells. (B) ELISA measuring the level of EpCAM binding by controls or recombinant EpCAM or non-specific bispecific T-cell activators. Significance was assessed by comparison to empty vector control sample using a one-way ANOVA test with Tukey's Post Hoc analysis, ***p<0.001

FIG. 48 Cytotoxicity of EnAd-expressing EpCAM Bispecific T-cell Activator in SKOV3 cells
SKOV3 cells were incubated with EnAd or recombinant viruses in the absence (A) or presence (B) of T cells and cytotoxicity was measured by LDH release at the specified time-points. Significance was assessed by comparison to uninfected control wells using a one-way ANOVA test with Tukey's Post Hoc analysis, ***p<0.001

FIG. 49 Identification of which T cells are responsible for Bispecific T-cell Activator-mediated cytotoxicity
- (A) bispecific T-cell activator-mediated T-cell activation of CD4 and CD8 cells 24 h after co-culture of CD3 T-cells with DLD cells (5:1) and bispecific T-cell activator-containing supernatant. Activation was assessed by surface expression of CD69 and CD25 and measured by flow cytometry. (B) Proliferative response of CFSE-stained CD4 and CD8 T-cells in co-culture with DLD cells and incubated with bispecific T-cell activator-containing supernatants. Fluorescence was measured after 5 days incubation, by FACS analysis. (C) Degranulation of CD4 and CD8 cells following 6 h co-culture with DLD cells and bispecific T-cell activator-containing supernatants. A CD107a-specific antibody is added to the culture media for the duration of the co-culture and degranulation is assessed by flow cytometry. (D) Cytotoxicity by either the CD4 or CD8 T-cell subset is assessed by LDH release into supernatant, following 24 h incubation of DLD cells with CD4- or CD8-purified T-cells (1:5) and bispecific T-cell activator containing supernatant Each condition was measured in biological triplicate and represented as mean±SD. EpCAM bispecific T-cell activator treatment was compared to control bispecific T-cell activator unless stated otherwise and significance was assessed using a one-way ANOVA test with Tukey's Post Hoc analysis, *p<0.05, p<0.01, *p<0.001.

FIG. 51 Characterisation of oncolytic virus EnAd expressing EpCAM Bispecific T-cell Activator using cell lines and PBMC derived T cells
- (A) DLD cells were infected with parental EnAd or recombinant virus (100 vp/cell) and wells harvested at 24 or 72 h. Replication was assessed by measuring genomes using qPCR against viral hexon. (B) Cytotoxicity of DLD cells infected with EnAd or recombinant virus at increasing concentrations of virus. Cytotoxicity was measured by MTS assay after 5 days infection. (C) Supernatants from day 3 uninfected or virus-infected HEK293A cells were assessed for transgene expression by immunoblot analysis and probed with an anti-His antibody. (D) Induction of activation marker CD25 of CD3-positive T-cells cultured with CHO or CHO-EpCAM (E:T 5:1) and diluted HEK293A supernatants from (D). Activation was measured by surface expression of CD25 by flow cytometry. (E) Cytotoxicity of CHO or CHO-EpCAM cells incubated with HEK293A supernatants from (D) alone or in co-culture with CD3-purified PBMC (E:T 5:1). HEK293A supernatants were diluted 300-fold. Cytotoxicity was assessed by LDH released into the supernatant after 24 h incubation. Each condition was measured in biological triplicate and represented as mean±SD. Significance was assessed using a one-way ANOVA test with Tukey's Post Hoc analysis with each condition compared to untreated, *p<0.05, p<0.01, *p<0.001.

FIG. 52 Cellular composition of the malignant exudates
  (A) Representative image (pleural effusion sample, Patient 3 from FIG. 57) demonstrating screening of ascites and exudate fluids for their cellular composition, as assessed by flow cytometry. (B) Absolute number of each cell type (in 10,000 cell sample size) is documented in the table.

FIG. 53 Superior potency of EnAd expressing EpCAM Bispecific T-cell Activator in partially EnAd-resistant cancer cell line
  (A-B) Viability of SKOV3 cells were monitored in real-time over 160 h by xCELLigence-based cytotoxicity assay. SKOV3 cells were seeded and infected with EnAd or bispecific T-cell activator-armed EnAd viruses at 0 h, with uninfected cells serving as a negative control. In (B) CD3-purified PBMC (5:1) were added 2 h post-infection and impedance was measured at 15 min intervals. (C-D) CD3-purified PBMC were cultured with SKOV3 cells (5:1) that were infected with parental EnAd or recombinant armed viruses. At each time-point, T cells were harvested and analysed for surface expression of CD69 (C) or CD25 (D) by flow cytometry. (E) Time-lapse sequences showing co-cultures of SKOV3 carcinoma cells (unstained), NHDF fibroblasts (red) and CD3-purified PBMC (blue), infected with EnAd, EnAd-CMVEpCAMbispecific T-cell activator or uninfected. Apoptosis was visualised using CellEvent Caspase 3/7 detection reagent (green). Images were taken on a Nikon TE 2000-E Eclipse inverted microscope at intervals of 15 min covering a period of 96 h. Representative images were recorded at the times displayed; original magnification×10; scale bar 100 nm. (A-D) Each condition was measured in biological triplicate and represented as mean±SD. Significance was assessed by comparison to uninfected control using a oneway ANOVA test with Tukey's Post Hoc analysis, *p<0.05, p<0.01, *p<0.001.

FIG. 57 EnAd expressing EpCAM Bispecific T-cell Activators can activate endogenous T cells to kill endogenous tumour cells within malignant pleural exudates
  Unpurified total cells from pleural effusions (from four different patients) were incubated in 100% fluid from the same pleural exudate in the presence of free bispecific T-cell activators, EnAd or recombinant virus. After 5 days, the total cell population was harvested, and the number of (A) CD3+ T cells and those which were (B) CD25+ were quantified. (C) The number of EpCAM+ cells was measured using flow cytometry. (D) Representative images (magnification×10; scale bar 100 μm) and flow cytometry analysis of pleural effusion cells of Patient 3 (cancer cells and lymphocytes) following treatment with EnAd or EnAd-CMVEpCAM bispecific T-cell activators. (E) At 5 days cytokine levels were measured by LEGENDplex human Th cytokine panel using pleural effusion cultures following incubation with free recombinant bispecific T-cell activators or infection with EnAd or recombinant virus. Each condition was measured in biological triplicate and represented as mean±SD. Significance was assessed by comparison to untreated control samples using a one-way ANOVA test with Tukey's Post Hoc analysis, *p<0.05, p<0.01, *p<0.001.

FIG. 68 shows a comparison of activation of T-cell cytokine production by recombinant FAP bispecific T-cell activators protein in the presence of human fibroblasts and by polyclonal activation with anti-CD3/CD28 beads. (A) IFNγ levels measured by ELISA. (B) Cytokine levels measured by cytokine bead array.

FIG. 69 FAP-targeted Bispecific T-cell Activator induces T-cell degranulation and specific cytotoxicity of FAP+ cells
(A) Degranulation of T-cells in culture with NHDF cells (5:1) and (B) bispecific T-cell activator-containing supernatants. Degranulation was assessed by externalisation of CD107a following 6 h culture with a CD107a-specific antibody and measured by flow cytometry. CD3/CD28 Dynabeads were used as a positive control. (C) Cytotoxicity of NHDF cells after 24 h in co-culture with T-cells (1:5) and 10-fold serial dilutions of bispecific T-cell activator-containing supernantants. Cytotoxicity was assessed by release of LDH into culture supernatants. (D) Lysis of NHDF by LDH release (left) and CD25 induction on T-cells (right) was assessed after 24 h co-culture with PBMC-derived T-cells (1:5) from six healthy donors and bispecific T-cell activator-containing supernatants.

FIG. 74 shows the effect of immunosuppressive ascites fluid samples on FAP bispecific T-cell activators- and anti-CD3/CD28 bead-mediated activation of PBMC T-cells. (A) PBMC T cells activated with anti-CD3/Cd28 Dynabeads. (B) PBMC T cells activated with control or FAP bispecific T-cell activators in the presence of NHDF cells. NS: normal serum, A: peritoneal ascites.

FIG. 76 Characterisation of architecture and cellular composition of solid prostate tumour
(A) EpCAM staining, (B) CD8 staining, (C) FAP staining. (D) Representative immunohistochemistry images of CD25 induction within prostate tumour slices following treatment with bispecific T-cell activators expressing viruses. Tumour cores were sliced at 300 uM thickness with a Leica vibratome, cultured and infected in inserts and harvested after 7 days treatment (E) Levels of IFNg in tissue slice culture medium measured by ELISA. Supernatants were harvested from slices cultures of malignant and benign tissue at the specified time-point. (F) Levels of IL-2 in tissue culture medium of malignant and benign tissue measured by ELISA.

FIG. 77 (A-C) shows a schematic representation of the transgene cassettes used in Example 33.

(D) shows a graph indicating the number of viral genomes detected per cell in NG-611, NG-612 and NG-617 treated tumour cells.

Figure 78:
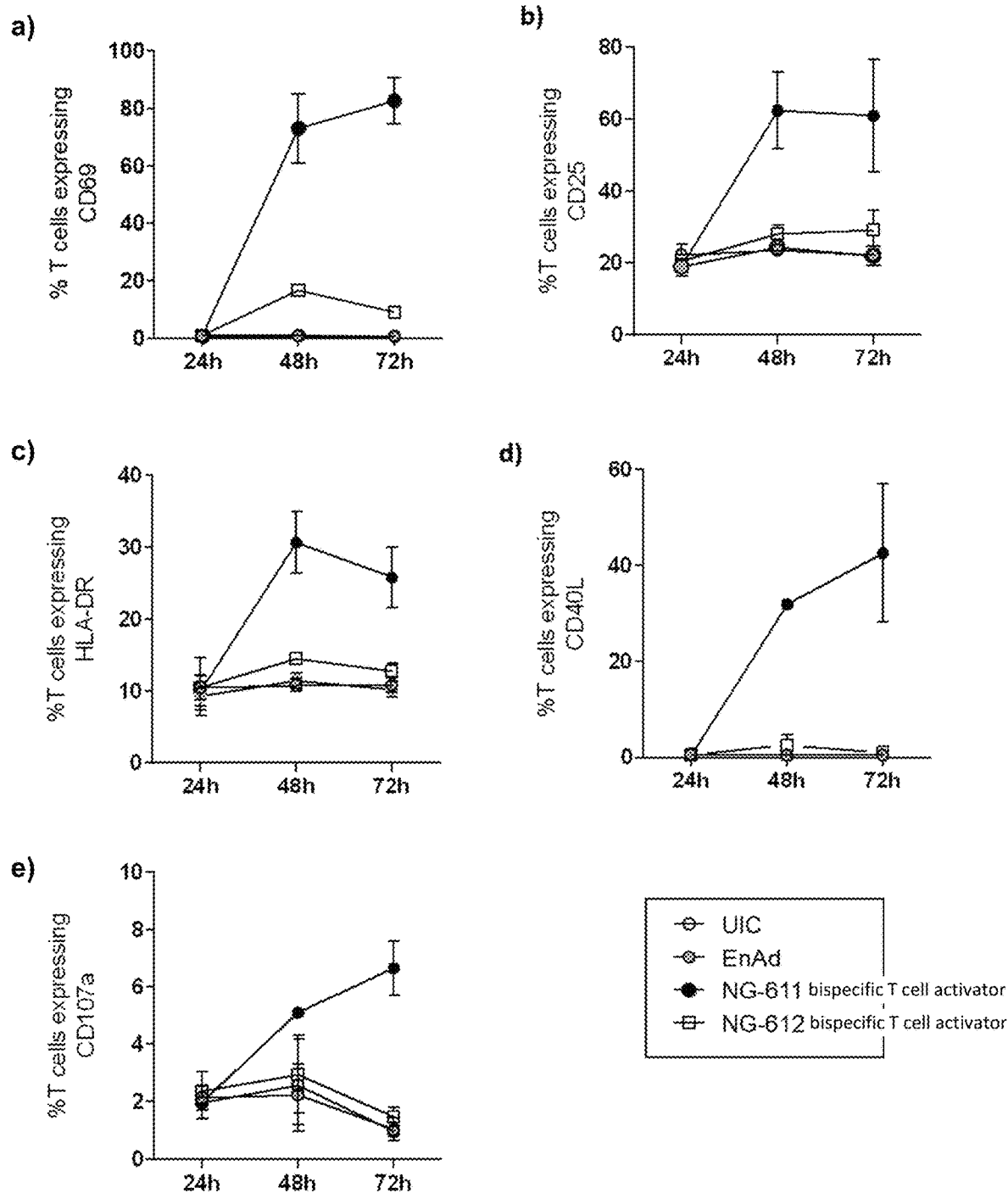

FIG. 78 shows the percentage of T cells expressing CD69 (a), CD25 (b) HLA-DR (c), CD40L (d) or cell surface CD107a (e) following co-culture with EpCam expressing SKOV cells and supernatants harvested from A549 cells at 24, 48 or 72 hrs post-treatment with NG-611 virus particles compared to NG-612, enadenotucirev or untreated control supernatants.

Figure 79:
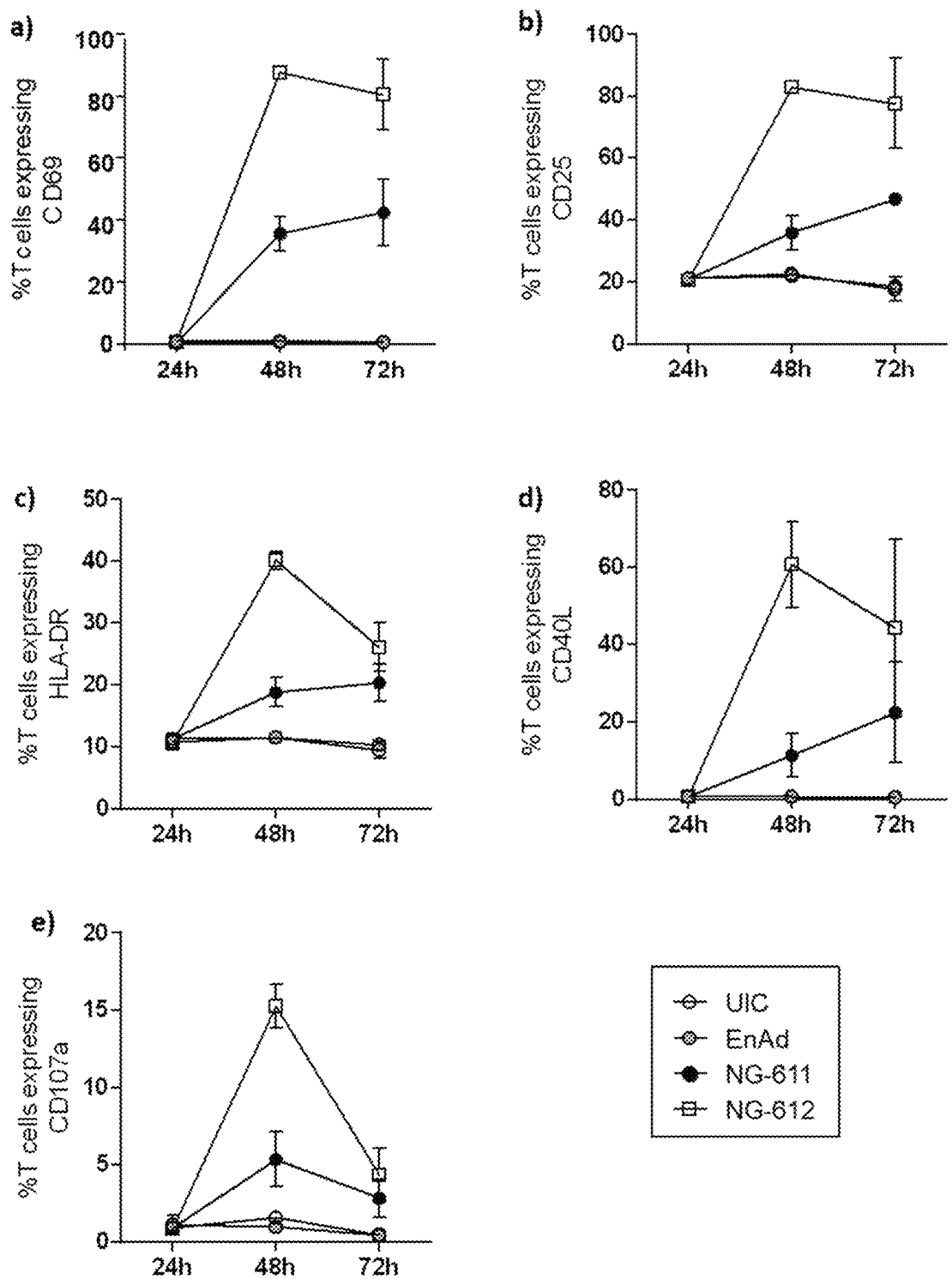

FIG. 79 shows the percentage of T cells expressing CD69 (a), CD25 (b) HLA-DR (c), CD40L (d) or cell surface CD107a (e) following co-culture with FAP expressing MRC-5 cells and supernatants harvested from A549 cells at 24, 48, or 72 hrs post-treatment with NG-612 virus particles compared to NG-611, enadenotucirev or untreated control supernatants.

Figure 80:
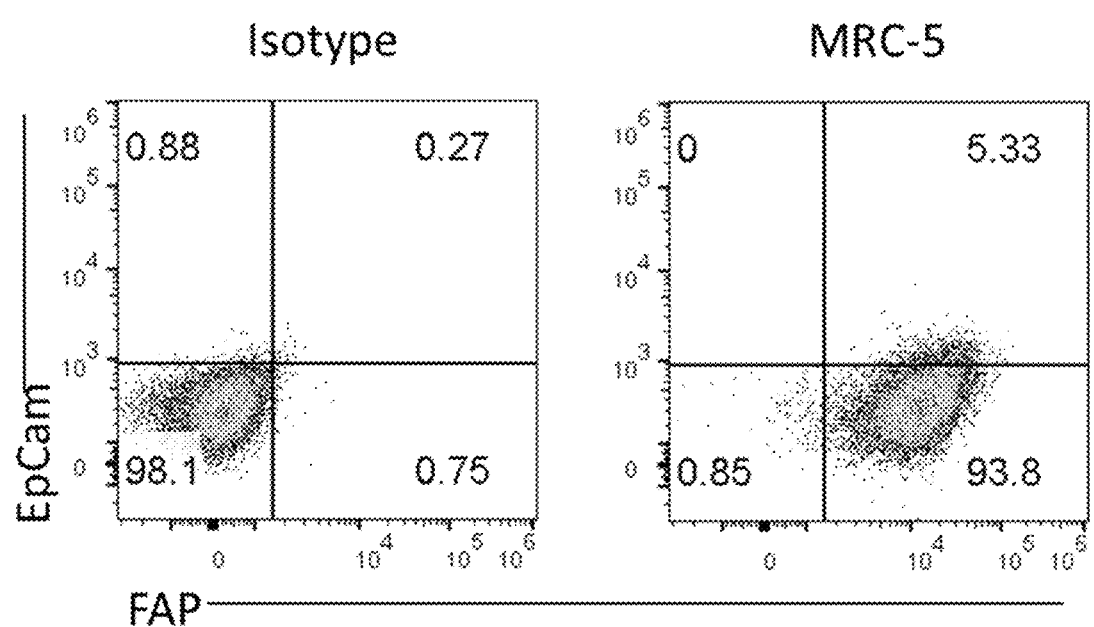

FIG. 80 shows the percentage of MRC-5 cells that express EpCAM and FAP

FIG. 81 shows IFNγ expression in the supernatants of T cell co-cultures with SKOV cells (A) or MRC-5 cells (B) incubated with supernatants harvested from A549 cells at 24, 48 or 72 hrs post-treatment with NG-611, NG-612 or enadenotucirev virus particles, or untreated control supernatants.

FIG. 82 shows anti-tumour efficacy and immune activation of bispecific T-cell activators expressing viruses in vivo. (a) tumour volume in mice treated with saline, enadenotucirev or NG-611. (b) Ratio of CD8 to CD4 T cells in NG-611 treated tumours compared to enadenotucirev treated or untreated controls.

Figure 83:
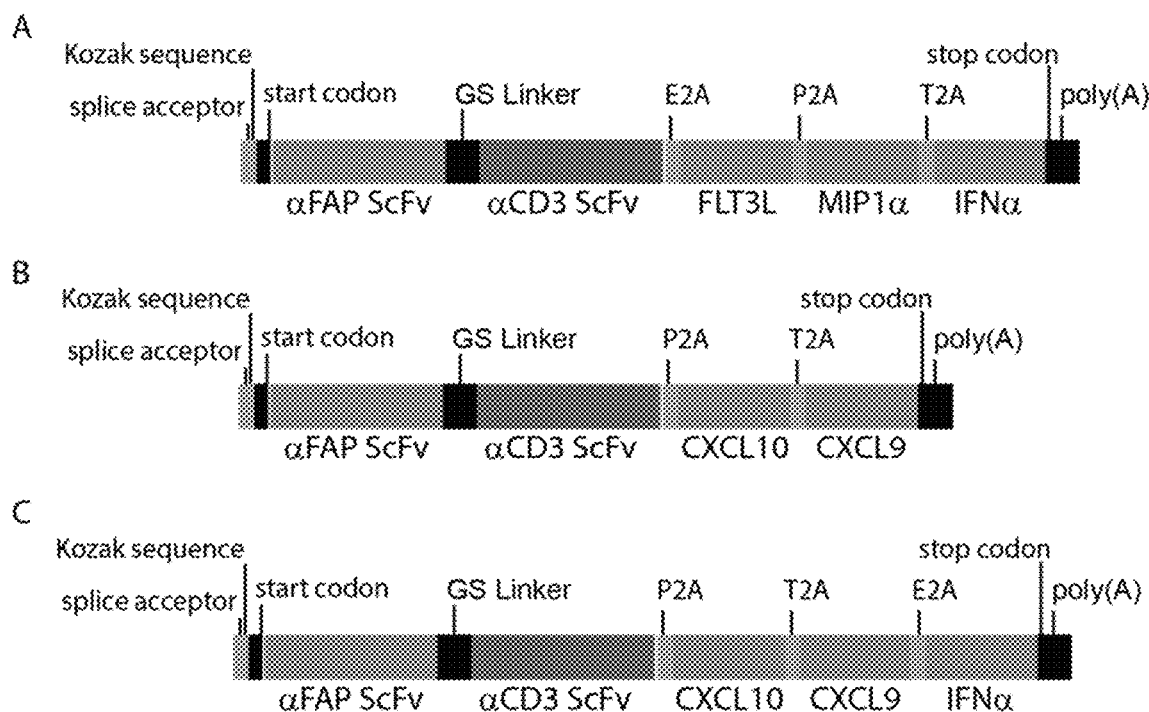

FIG. 83 shows schematic representation of transgene cassettes. (a) NG-615, (b) NG-640, (c) NG-641.

Figure 84:
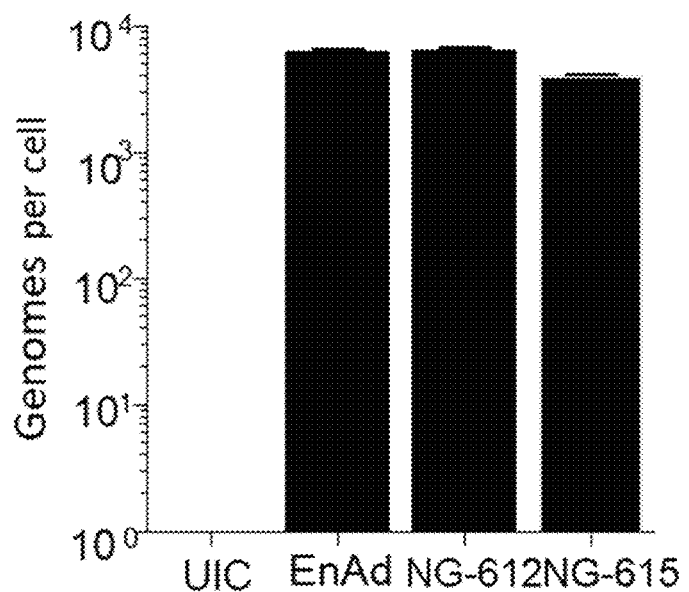
Figure 85:
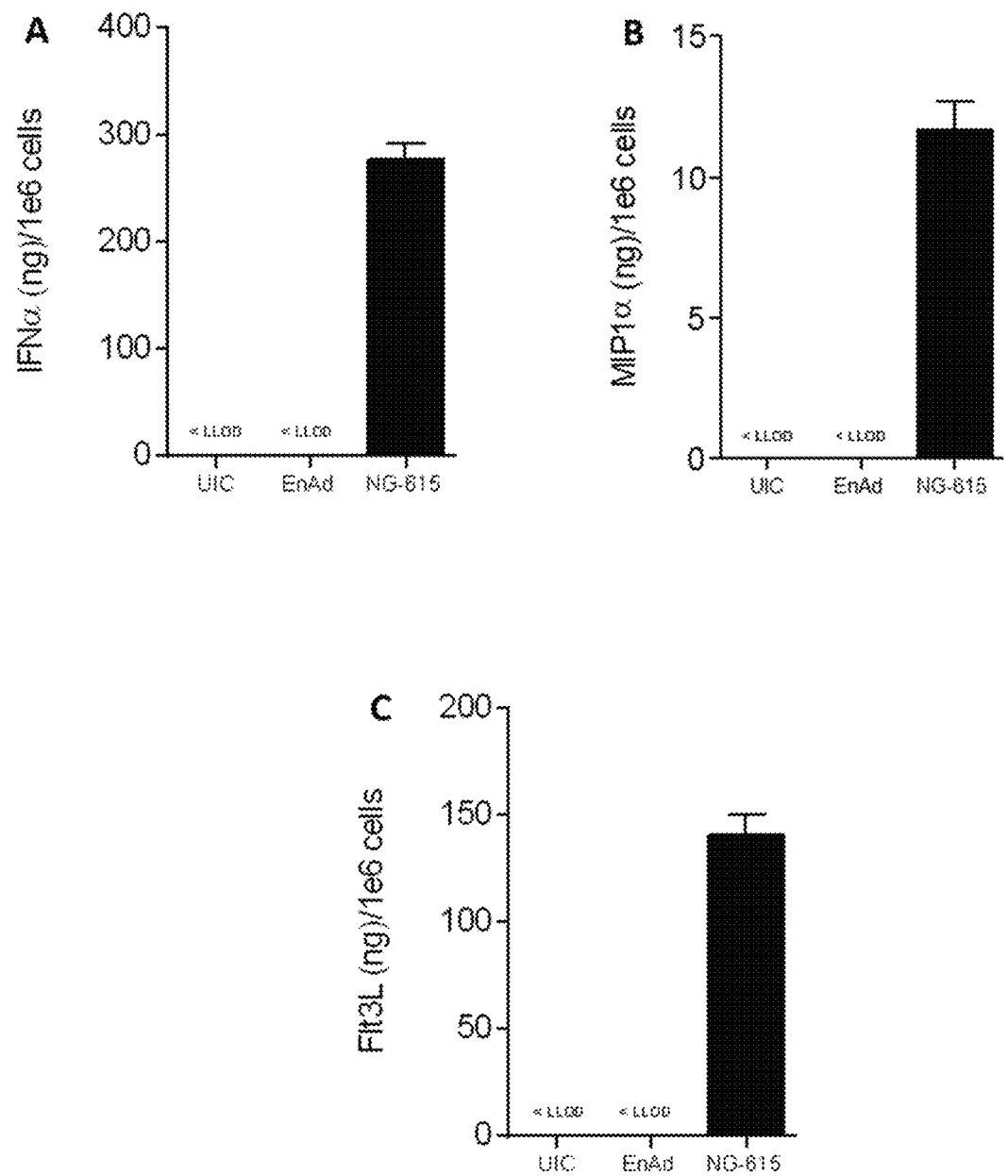

FIG. 84 shows a graph indicating the number of viral genomes detected per cell in NG-612 and NG-615 treated tumour cells FIG. 85 shows the expression of IFNα, MIP1a and Flt3 L in the cellular supernatant of NG-615 vs the supernatant of enadenotucirev and untreated control tumour cells.

Figure 86:
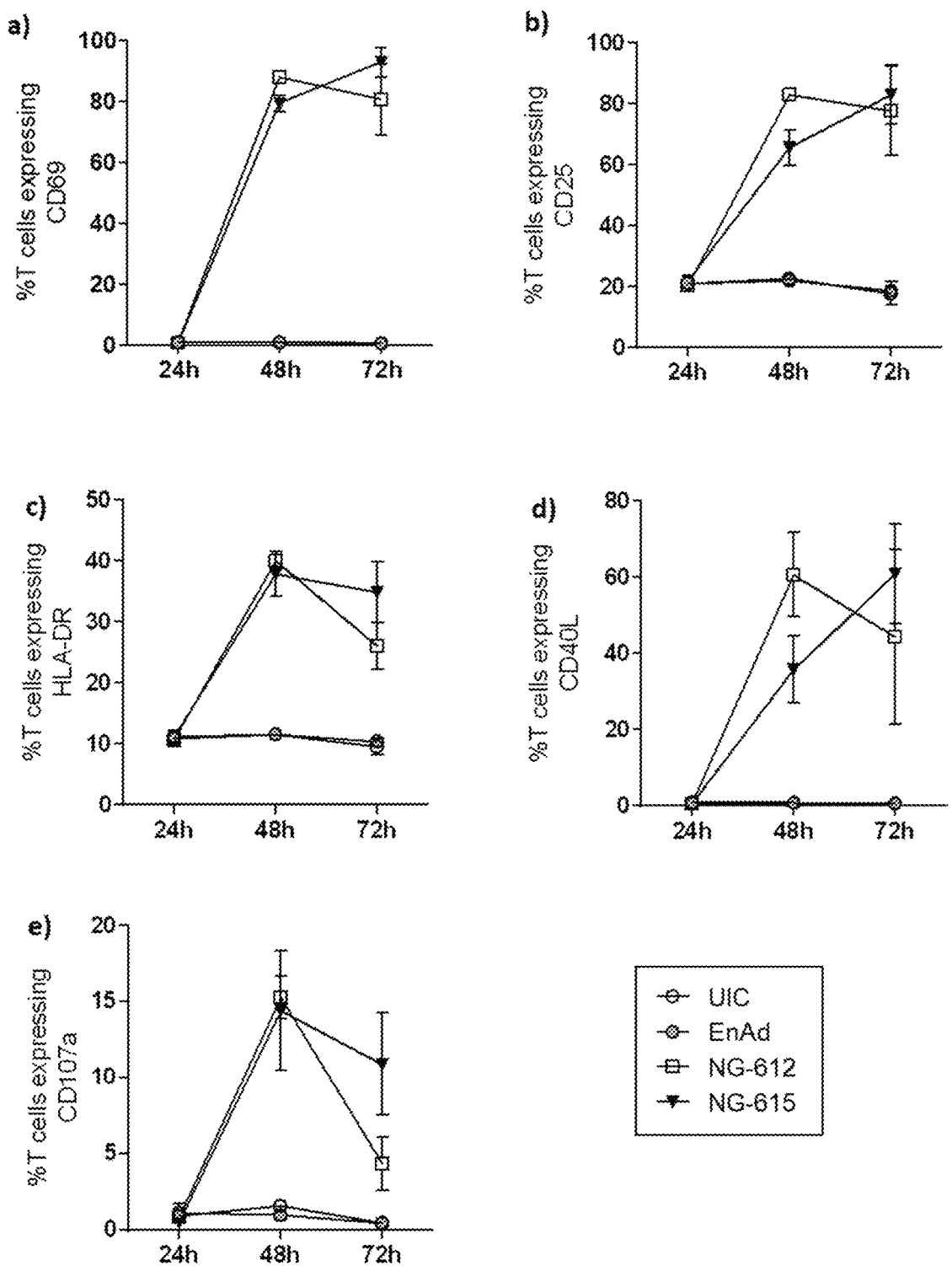

FIG. 86 shows the number of T cells expressing CD69 (a), CD25 (b) HLA-DR (c), CD40L (d) or cell surface CD107a (e)) following co-culture with FAP expressing MRC-5 cells and supernantants harvested from A549 cells at 24, 48 or 72 hrs post-treatment with NG-615 virus particles compared to NG-612, enadenotucirev or untreated control supernatants.

Figure 87:
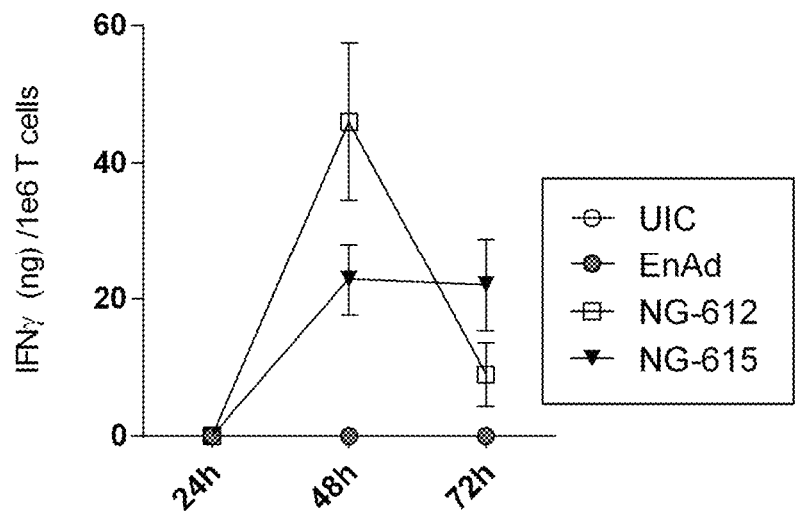

FIG. 87 shows IFNγ expression in the supernatants of T cell co-cultures with MRC-5 cells incubated with supernatants harvested from A549 cells at 24, 48 or 72 hrs post-treatment with NG-612, NG-615 or enadenotucirev virus particles, or untreated control supernatants.

Figure 88:
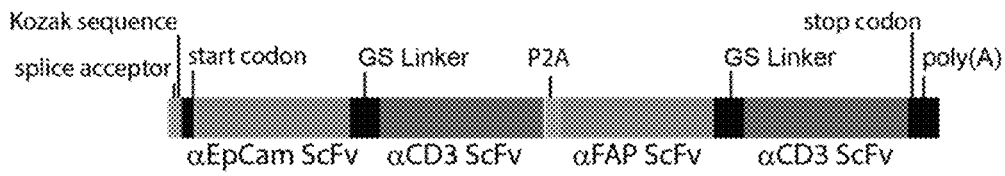

FIG. 88 shows schematic representation of the NG-618 transgene cassette

Figure 89:
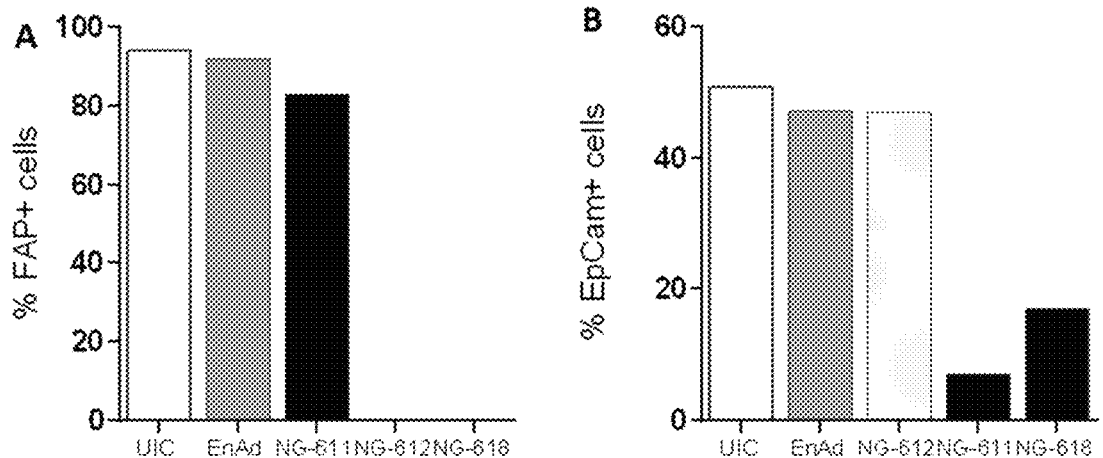

FIG. 89 shows the detection of surface FAP expression on MRC-5 cells (a) or EpCam expression on SKOV cells (b) following incubation with supernatants harvested from A549 cells at 72 hrs post-treatment with NG-611, NG-612, NG-615 or enadenotucirev virus particles.

FIG. 90 shows the percentage of T cells expressing CD24 (a), CD40L (b) or cell surface CD107a (c) following co-culture with FAP expressing MRC-5 cells and supernatants harvested from A549 cells at 72 hrs post-treatment with NG-618 virus particles compared to enadenotucirev or untreated controls.

Figure 91:
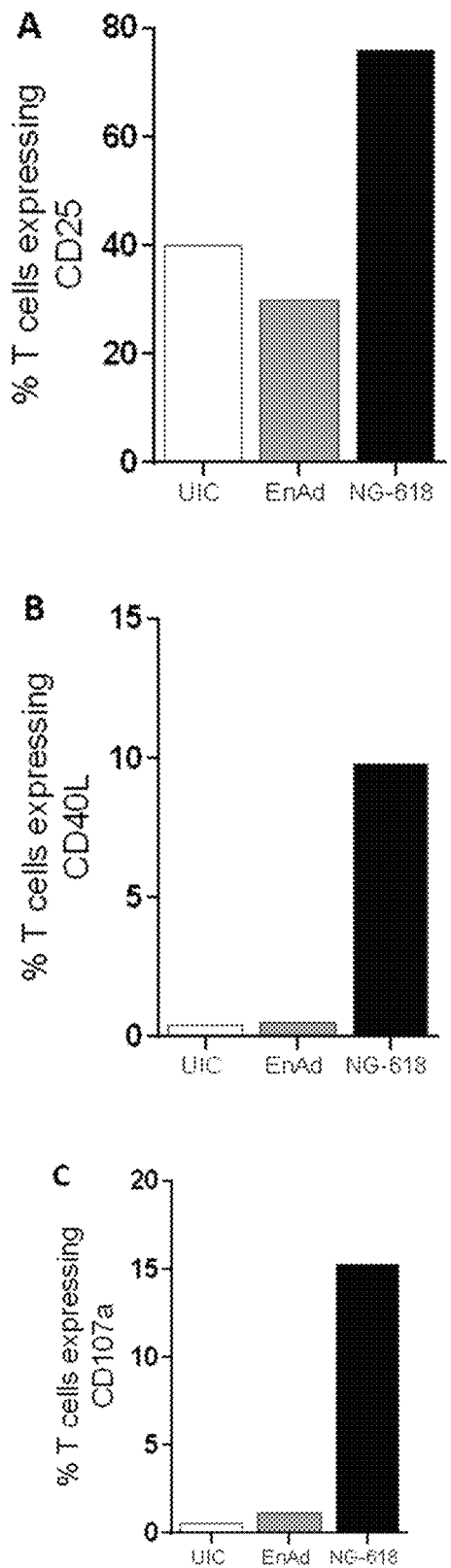

FIG. 91 shows the percentage of T cells expressing CD24 (a), CD40L (b) or cell surface CD107a (c) following co-culture with EpCam expressing SKOV cells and supernatants harvested from A549 cells at 72 hrs post-treatment with NG-618 virus particles compared to enadenotucirev or untreated controls.

Figure 92:
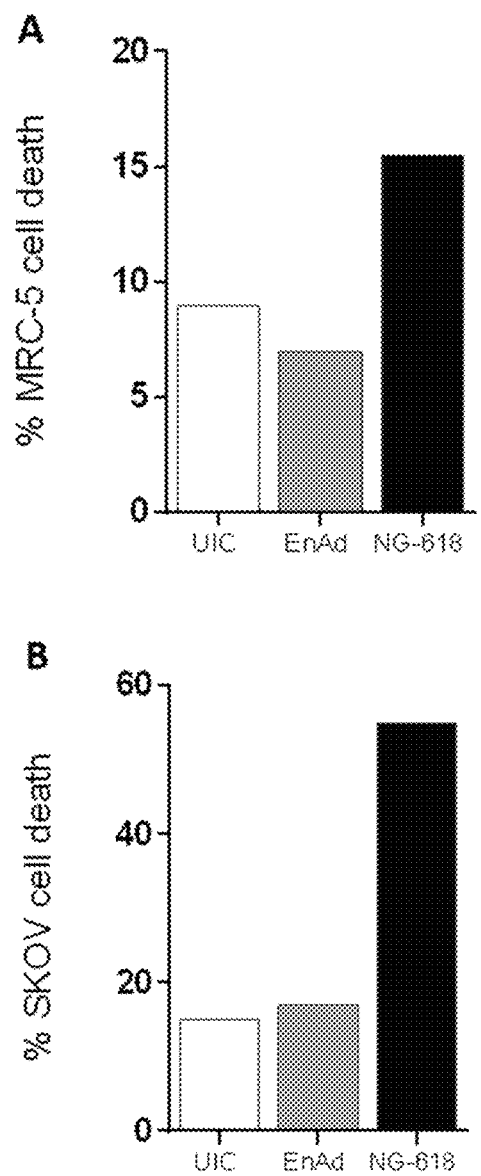

FIG. 92 shows the percentage of dead MRC-5 (a) or SKOV (b) cells following co-culture with T cells and supernatants harvested from A549 cells at 72 hrs post-treatment with NG-618 virus particles compared to enadenotucirev or untreated controls.

SEQUENCES

SEQ ID NO: 1 Anti-EpCAM Bispecific T-cell activator DNA coding sequence, with N-terminal signal sequence and C-terminal deca-His affinity tag SEQ ID NO: 2 Anti-EpCAM bispecific T-cell activator protein sequence, with N-terminal signal sequence and C-terminal deca-His affinity tag SEQ ID NO: 3 Anti-FAP bispecific T-cell activators DNA coding sequence, with N-terminal signal sequence and C-terminal deca-His affinity tag SEQ ID NO: 4 Anti-FAP bispecific T-cell activator amino acid sequence, with N-terminal signal sequence and C-terminal deca-His affinity tag SEQ ID NO: 5: Control (Anti-FHA) bispecific T-cell activator DNA coding sequence, with N-terminal signal sequence and C-terminal deca-His affinity tag SEQ ID NO: 6: Control (Anti-FHA) bispecific T-cell activator amino acid sequence with N-terminal signal sequence and C-terminal deca-His affinity tag SEQ ID NO: 7: Anti-CD3 ScFv amino acid sequence SEQ ID NO: 8: Anti-CD3 VH SEQ ID NO: 9: Anti-CD3 VL SEQ ID NO: 10: Anti-CD3 ScFv linker sequence SEQ ID NO: 11: Anti-FAP ScFv SEQ ID NO: 12: Anti-FAP VL domain SEQ ID NO: 13: Anti-FAP VH domain SEQ ID NO: 14: Anti-FAP and Anti-EpCAM linker sequence SEQ ID NO: 15: bispecific T-cell activator leader sequence SEQ ID NO: 16: Anti-EpCAM ScFv SEQ ID NO: 17: Anti-EpCAM VL SEQ ID NO: 18: Anti-EpCAM VH SEQ ID NO: 19: Control bispecific T-cell activator (Anti-FHA)

SEQ ID NO: 20: Control (Anti-FHA) ScFv

SEQ ID NO: 21: Control (Anti-FHA) VL

SEQ ID NO: 22: Control (Anti-FHA) VH

SEQ ID NO: 23: Control (Anti-FHA) ScFv linker sequence

SEQ ID NO: 24: Deca-His Tag sequence

SEQ ID NO: 25: FAP bispecific T-cell activator-P2A-RFP (ITALICS=leader, BOLD=furin cleavage site, UNDERLINE= P2A sequence, lower case=RFP)

SEQ ID NO: 26: Control (Anti-FHA) bispecific T-cell activator-P2A-RFP (ITALICS=leader, BOLD=furin cleavage site, UNDERLINE=P2A sequence, lower case=RFP)
SEQ ID NO: 27: Human EpCAM DNA coding sequence
SEQ ID NO: 28: Human EpCAM amino acid sequence
SEQ ID NO: 29: Human FAP DNA coding sequence
SEQ ID NO: 30: Human FAP amino acid sequence
SEQ ID NO: 31: CMV promoter sequence
SEQ ID NO: 32: SV40 late polyadenylation sequence
SEQ ID NO: 33: Null sequence
SEQ ID NO: 34: NG-601 (EnAd-CMV-EpCAMbispecific T-cell activator)
SEQ ID NO: 35: NG-602 (EnAd-SA-EpCAMbispecific T-cell activator)
SEQ ID NO: 36: NG-605 (EnAd-CMV-FAPbispecific T-cell activator)
SEQ ID NO: 37: NG-606 (EnAd-SA-FAPbispecific T-cell activator)
SEQ ID NO: 38 EnAd genome
SEQ ID NO: 39 $B_X$ DNA sequence corresponding to and including bp 28166-28366 of the EnAd genome
SEQ ID NO: 40 $B_Y$ DNA sequence corresponding to and including bp 29345-29379 of the EnAd genome
SEQ ID NO: 41 HIS-Tag
SEQ ID NO: 42 Splice acceptor sequence.
SEQ ID NO: 43 SV40 poly Adenylation sequence
SEQ ID NO: 44 EpCam bispecific T-cell activator nucleic acid sequence (OKT3)
SEQ ID NO: 45 FAP bispecific T-cell activator nucleic acid sequence (OKT3)
SEQ ID NO: 46 FAP bispecific T-cell activator nucleic acid sequence (aCD3)
SEQ ID NO: 47 NG-611 Transgene cassette
SEQ ID NO: 48 NG-612 Transgene cassette
SEQ ID NO: 49 NG-613 Transgene cassette
SEQ ID NO: 50 Restriction site insert ($B_X$)
SEQ ID NO: 51 Restriction site insert ($B_Y$)
SEQ ID NO: 52 CMV promoter sequence
SEQ ID NO: 53 PGK promoter sequence
SEQ ID NO: 54 CBA promoter sequence
SEQ ID NO: 55 short splice acceptor (SSA) DNA sequence
SEQ ID NO: 56 splice acceptor (SA) DNA sequence
SEQ ID NO: 57 branched splice acceptor (bSA) DNA sequence
SEQ ID NO: 58 Kozak sequence (null sequence)
SEQ ID NO: 59 Example of start codon
SEQ ID NO: 60 Internal Ribosome Entry Sequence (IRES)
SEQ ID NO: 61 P2A peptide
SEQ ID NO: 62 F2A peptide
SEQ ID NO: 63 E2A peptide
SEQ ID NO: 64 T2A peptide
SEQ ID NO: 65 polyadenylation (polyA) sequence
SEQ ID NO: 66 Leader sequence
SEQ ID NO: 67 Leader sequence
SEQ ID NO: 68 IFNγ amino acid sequence
SEQ ID NO: 69 IFNα amino acid sequence
SEQ ID NO: 70 TNFα amino acid sequence
SEQ ID NO: 71 DNA sequence corresponding to E2B region of the EnAd genome (bp 10355-5068)
SEQ ID NO: 72: Anti-EpCAM bispecific T-cell activator DNA coding sequence, with N-terminal signal sequence and C-terminal deca-His affinity tag
SEQ ID NO: 73: Anti-EpCAM bispecific T-cell activator protein sequence, with N-terminal signal sequence without C-terminal deca-His affinity tag
SEQ ID NO: 74: Anti-FAP bispecific T-cell activator DNA coding sequence, with N-terminal signal sequence without C-terminal deca-His affinity tag
SEQ ID NO: 75: Anti-FAP bispecific T-cell activator amino acid sequence, with N-terminal signal sequence without C-terminal deca-His affinity tag
SEQ ID NO: 76: Control (Anti-FHA) bispecific T-cell activator DNA coding sequence, with N-terminal signal sequence without C-terminal deca-His affinity tag
SEQ ID NO: 77: Control (Anti-FHA) bispecific T-cell activator amino acid sequence with N-terminal signal sequence without C-terminal deca-His affinity tag
SEQ ID NO: 78: Control bispecific T-cell activator (Anti-FHA) without C-terminal deca-His affinity tag
SEQ ID NO: 79: NG-601 (EnAd-CMV-EpCAMbispecific T-cell activator) without deca-His affinity tag
SEQ ID NO: 80: NG-602 (EnAd-SA-EpCAMbispecific T-cell activator) without deca-His affinity tag
SEQ ID NO: 81: NG-605 (EnAd-CMV-FAPbispecific T-cell activator) without deca-His affinity tag
SEQ ID NO: 82: NG-606 (EnAd-SA-FAPbispecific T-cell activator) without deca-His affinity tag
SEQ ID NO: 83: EpCam bispecific T-cell activator nucleic acid sequence (OKT3)
SEQ ID NO: 84: Null sequence
SEQ ID NO: 85: FAP bispecific T-cell activator nucleic acid sequence (OKT3)
SEQ ID NO: 86: Null sequence
SEQ ID NO: 87: FAP bispecific T-cell activator nucleic acid sequence (aCD3)
SEQ ID NO: 88: NG-611 Transgene cassette
SEQ ID NO: 89: NG-612 Transgene cassette
SEQ ID NO: 90: NG-613 Transgene cassette
SEQ ID NO: 91: NG-614 Transgene cassette
SEQ ID NO: 92: NG-617 Transgene cassette
SEQ ID NO: 93: EpCam bispecific T-cell activator amino acid sequence (OKT3)
SEQ ID NO: 94: FAP bispecific T-cell activator amino acid sequence (OKT3)
SEQ ID NO: 95: FAP bispecific T-cell activator amino acid sequence (aCD3)
SEQ ID NO: 96: NG-611 Genome
SEQ ID NO: 97: NG-612 Genome
SEQ ID NO: 98: NG-613 Genome
SEQ ID NO: 99: NG-614 Genome
SEQ ID NO: 100: NG-617 Genome
SEQ ID NO: 101: NG-615 Genome
SEQ ID NO: 102: NG-640 Genome
SEQ ID NO: 103: NG-641 Genome
SEQ ID NO: 104: Null sequence
SEQ ID NO: 105: Flt3L nucleic acid sequence
SEQ ID NO: 106: Null sequence
SEQ ID NO: 107: MIP1a nucleic acid sequence
SEQ ID NO: 108: Flexible linker sequence
SEQ ID NO: 109: IFNα nucleic acid sequence
SEQ ID NO: 110: CXCL10 nucleic acid sequence
SEQ ID NO: 111: CXCL9 nucleic acid sequence
SEQ ID NO: 112: NG-615 Transgene cassette
SEQ ID NO: 113: NG-640 Transgene cassette
SEQ ID NO: 114: NG-641 Transgene cassette
SEQ ID NO: 115: FLT3L amino acid sequence
SEQ ID NO: 116: MIP1a amino acid sequence
SEQ ID NO: 117: IFNα amino acid sequence
SEQ ID NO: 118: CXCL9 amino acid sequence
SEQ ID NO: 119: CXCL10 amino acid sequence
SEQ ID NO: 120: NG-618 Genome SEQ ID NO: 121: NG-618 EpCam bispecific T-cell activator nucleic acid sequence
SEQ ID NO: 122: NG-618 FAP bispecific T-cell activator nucleic acid sequence
SEQ ID NO: 123: NG-618 Transgene cassette
SEQ ID NO: 124 to 297 are linker sequences
SEQ ID NO: 298 NG-616 Genome

EXAMPLES

Example 1

Recombinant bispecific T-cell activators were designed and proteins produced as described in this example.
Bispecific T-Cell Activator Engineering Bispecific T-cell activators are generated by joining two single chain antibody fragments (ScFv) of different specificities with a flexible Gly 4 Ser linker. ScFv's are created by the joining of $V_H$ and $V_L$ domains from parental monoclonal antibodies by a linker. Each bispecific T-cell activator was designed with an N-terminal signal sequence for mammalian secretion and a C-terminal decahistidine affinity tag for detection and purification. bispecific T-cell activators were engineered by standard DNA cloning techniques and inserted into protein expression vectors (FIG. 1). The anti-EpCAM bispecific T-cell activator is that from patent WO 2005040220 (SEQ ID NO: 63 therein), with a signal sequence and affinity tag added. The anti-FAP bispecific T-cell activator was created de novo using the anti-FAP ScFv from patent WO2010037835A2 and the anti-CD3 ScFv from patent WO 2005040220 (SEQ ID 63 therein), with a signal sequence and affinity tag added. A control bispecific T-cell activator used the anti-FHA (filamentous haemagglutinin from *Bordetella pertussis*) ScFv from Hussein et al, 2007 (Hussein A H et al (2007) "Construction and characterization of single-chain variable fragment antibodies directed against the *Bordetella pertussis* surface adhesins filamentous hemagglutinin and pertactin". Infect Immunity 75, 5476-5482) and the anti-CD3 ScFv from patent WO 2005040220 (SEQ ID NO: 63 therein), with a signal sequence and affinity tag added. The DNA coding and amino acid sequences for these bispecific T-cell activators are SEQ ID NOs: 1-6.
Recombinant Bispecific T-Cell Activators Production Recombinant bispecific T-cell activator proteins were produced by cloning the respective sequences into the pSF-CMV vector using a CMV promoter (SEQ ID NO: 31) to drive protein expression (FIG. 1). The concentration of plasmid DNA for plasmids, pSF-CMV-EpCAMbispecific T-cell activators, p5F-CMV-FAPbispecific T-cell activators and pSF-CMV-Controlbispecific T-cell activators (Table 2), were measured via NanoDrop. Empty pSF-CMV vector is included as a negative control. 54.7 jig of each was diluted with 4 mL OptiMEM. 109.2 ug PEI (linear, MW 25000, Polysciences, USA) were diluted in 4 mL OptiMEM medium and mixed with the 4 ml of diluted DNA to generate DNA-PEI complexes (DNA:PEI ratio of 1:2 (w/w)). After incubation at room temperature for 20 minutes, the complex mixture was topped up to 18 mL with OptiMEM and this transfection mixture was added to a T175 flask containing Ad293 cells at 90% confluency. After incubation of the cells with the transfection mix for 4 hrs at 37° C., 5% $CO_2$, 30 mL of cell media (DMEM high glucose with glutamine supplemented, phenol red-free) was added to the cells and the flasks were incubated 37° C., 5% $CO_2$ for 48 hours. Another flask of cells was transfected in parallel with pSF-CMV-GFP to ensure efficient transfection efficiency. In order to harvest secreted protein, the supernatant of transfected cells was collected and centrifuged at 350 g at 4° C. for 5 minutes to remove cell components (Allegra X-15R, Beckman Coulter). Supernatants were transferred to 10k MWCO Amicon Ultra-15 Centrifugal Filter Units (Millipore). After spinning at 4750 rpm and 4° C., the volume of the retentate was adjusted with the flow through to obtain a 50-fold higher concentration. Aliquots of concentrated protein were stored at −80° C.

TABLE 2

"p" employed as a prefix in naming constructs indicates that the construct is a plasmid.

| Plasmid ID | Coding Sequence SEQ ID NO: | [plasmid DNA] ng/ml |
|---|---|---|
| pSF-CMV-EpCAMBispecific T-cell activator | SEQ ID NO: 1 | 3717 |
| pSF-CMV-FAPBispecific T-cell activator | SEQ ID NO: 3 | 6700 |
| pSF-CMV-ControlBispecific T-cell activator | SEQ ID NO: 5 | 5300 |
| pSF-Lenti-EpCAM | SEQ ID NO: 27 | 2529.3 |
| pSF-Lenti-FAP | SEQ ID NO: 29 | 659.6 |

Recombinant Bispecific T-cell activator detection

To detect the bispecific T-cell activators, the C-terminal decahistidine affinity tag can be probed with an anti-His antibody using the technique of western blotting. Protein samples were adjusted with lysis buffer to a final volume of 15 μL including 2.5 μL 6× Laemmli SDS Sample Buffer which contains 3-mercaptoethanol and SDS. Samples were incubated for 5 minutes at 95° C. to denature proteins and loaded onto 15-well 10% precast polyacrylamide gels (Mini-PROTEAN TGX Precast Gels, BioRad, UK). Gels were run at 180 V for 45 minutes in 1× running buffer within a Mini-PROTEAN Tetra System (BioRad, UK). Proteins from the SDS gels were transferred onto nitrocellulose membranes by wet electroblotting at 300 mA and 4° C. for 90 minutes in 1× transfer buffer within a Mini Trans-Blot Cell (BioRad, UK). Transfer was performed in presence of an ice pack to limit heat. The nitrocellulose membrane was then blocked with 5% milk in PBS-T on a shaker for 1 hour at room temperature, and probed with anti-His (C-term) antibody (mouse α-6×His, clone 3D5, Invitrogen, UK, #46-0693), diluted 1:5000 in PBS/5% milk. After incubation on a shaker overnight at 4° C., the membrane was washed and probed with HRP-labelled polyclonal secondary α-mouse-immunoglobulin-antibody (1:10.000 in PBS/5% milk, Dako, #P0161) for 1 hour at room temperature. For visualization, SuperSignal West Dura Extended Duration Substrate (Thermo Fisher Scientific, UK) was applied, following manufacturer's instructions and exposed to X-ray film and developed in an automatic film processor. The results demonstrated the expression and secretion of bispecific T-cell activators protein from Ad293 cells transfected with the bispecific T-cell activators expression plasmids, but not the parental vector.
Recombinant Bispecific T-Cell Activatos Quantification To measure the quantity of recombinant bispecific T-cell activator protein, the technique of dot blot was used to compare the bispecific T-cell activator signal to a His-tagged (C-term 10His) protein standard (10×His-tagged human Cathepsin D, Biolegend, #556704). Two-fold serial dilutions of bispecific T-cell activator samples and protein standard were prepared, and 1.5 uL of each directly applied to a nitrocellulose membrane and air-dried for 20 minutes. The blocking and staining protocol described above for western blotting was then performed. The molar concentration of the protein standard was adjusted to represent a bispecific T-cell activator concentration of 250 µg/mL. The results (FIG. 2, panel A) demonstrated the expression and secretion of bispecific T-cell activator protein from Ad293 cells transfected with the bispecific T-cell activator expression plasmids.

FAP Binding ELISA

The FAP-binding activity of the FAP bispecific T-cell activators and control (anti-FHA) bispecific T-cell activators (SEQ ID NOs: 4 and 6) secreted from cells transfected with pSF-CMV-FAPbispecific T-cell activator or pSF-CMV-Controlbispecific T-cell activator was assessed by enzyme-linked immunosorbent assay (ELISA). Empty pSF-CMV vector supernatants were included as a negative control. ELISA plates (Nunc Immuno MaxiSorp 96 well microplate) were prepared by coating overnight at 4° C. with human FAP/seprase protein (100 ng/well, Sino Biological Inc, 10464-H07H-10) in PBS buffer. Plates were washed between all subsequent binding steps with PBS 0.05% Tween 20. The plates were blocked for 1 hour at room temperature with 5% BSA in PBS 0.05% Tween 20. Aliquots of bispecific T-cell activator protein, or protein harvested from empty pSF-CMV vector-transfected wells, were diluted 10-fold into PBS/5% BSA/0.05% Tween 20. All samples were added to the FAP coated plates and incubated for 2 hr at room temperature. The detection antibody, anti-His (C-term) antibody (mouse anti-6×His, clone 3D5, Invitrogen, UK, #46-0693), was diluted 1:1000 and applied for 1 hour at room temperature. HRP conjugated anti-mouse-Fc (1:1000 in PBS/5% milk, Dako) was then applied for 1 hr at room temperature before HRP detection was performed with HRP substrate solution 3.3.5.5'-teramethylethylenediamine (TMB, Thermo-Fisher). Stop solution was used for terminating the reaction and the developed colour was measured at 450 nm on a plate reader. Absorbance at 450 nm was plotted for FAP bispecific T-cell activators, control bispecific T-cell activators and empty vector supernatants, demonstrating specific binding of the FAP bispecific T-cell activators to FAP protein. The results (FIG. 2, panel B) show the specific binding of the FAP bispecific T-cell activators and not control bispecific T-cell activators to recombinant FAP protein.

EpCAM Binding ELISA

The EpCAM-binding activity of the EpCAM bispecific T-cell activators and control bispecific T-cell activators (SEQ ID NOs: 2 and 6) secreted from cells transfected with pSF-CMV-EpCAMBispecific T-cell activator or pSF-CMV-Controlbispecific T-cell activator was assessed by enzyme-linked immunosorbent assay (ELISA). Empty pSF-CMV vector supernatants are included as a negative control. ELISA plates (A Nunc Immuno MaxiSorp 96 well microplate) were prepared by coating overnight at 4° C. with human EpCAM/TROP-1 protein (50 ng/well, Sino Biological Inc, #10694-H02H-50) in PBS buffer. Plates were washed between all subsequent binding steps with PBS 0.05% Tween 20. The plates were blocked for 1 hour at room temperature with 5% BSA in PBS 0.05% Tween 20. Aliquots of bispecific T-cell activator protein, or protein harvested from empty pSF-CMV vector-transfected wells, were diluted 10-fold into PBS/5% BSA/0.05% Tween 20. All samples were added to the EpCAM coated plates and incubated for 2 hr at room temperature. The detection antibody anti-His (C-term) antibody (mouse anti-6×His, clone 3D5, Invitrogen, UK, #46-0693) was diluted 1:5000 and applied for 1 hour at room temperature. HRP conjugated anti-mouse-Fc (1:1000 in PBS/5% milk, Dako,) was then applied for 1 hr at room temperature before HRP detection was performed with HRP substrate solution 3.3.5.5'-teramethylethylenediamine (TMB, Thermo-Fisher). Stop solution was used for terminating the reaction and the developed colour was measured at 450 nm on a plate reader. Absorbance at 450 nm was plotted for EpCAM bispecific T-cell activators, control bispecific T-cell activators and empty vector supernatants demonstrating specific binding of EpCAM bispecific T-cell activators to recombinant EpCAM. The results (FIG. 2, panel C) show the specific binding of the EpCAM bispecific T-cell activators and not control bispecific T-cell activators to recombinant EpCAM protein.

Example 2

The functional activities of recombinant bispecific T-cell activator proteins were assessed in a number of different assays prior to constructing bispecific T-cell activator transgene-bearing EnAd viruses.

Isolation of Human Peripheral Blood Mononuclear Cells (PBMCs)

Human PBMCs were isolated by density gradient centrifugation either from fresh human blood samples of healthy donors or from whole blood leukocyte cones, obtained from the NHS Blood and Transplant UK in Oxford. In either case, the samples were diluted 1:2 with PBS and 25 mL of this mixture was layered onto 13 mL Ficoll (1.079 g/mL, Ficoll-Paque Plus, GE Healthcare) in a 50 mL Falcon tube. Samples were centrifuged (Allegra X-15R, Beckman Coulter) at 1600 rpm for 30 minutes at 22° C. with the lowest deceleration setting to preserve phase separation. After centrifugation, 4 layers could be observed which included a plasma layer at the top, followed by an interface containing PBMCs, a Ficoll layer and a layer of red blood cells and granulocytes at the bottom. The PBMCs were collected using a Pasteur pipette and washed twice with PBS (1200 rpm for 10 minutes at room temperature) and re-suspended in RPMI medium supplemented with 10% FBS.

Isolation of CD3-Positive T-Cells

CD3-positive (CD3±) T-cells were extracted from PBMCs by depletion of non-CD3 cells using a Pan T Cell Isolation Kit (Miltenyi Biotec, #130-096-535), according to the manufacturer's protocol.

Processing Primary Ascites Samples

Primary human ascites samples were received from the oncology ward of the Churchill Hospital (Oxford University Hospitals) from patients with multiple indications, including but not limited to ovarian, pancreatic, breast and gastric cancer. Upon receipt, cellular and fluid fractions were separated, with aliquots of fluid frozen at −20° C. for storage and future analysis. The cellular fraction was treated with red blood cell lysis buffer (Roche, #11814389001) to remove red blood cells, following the manufacturer's instructions. Cell types present in each sample was determined by staining for EpCAM, EGFR, FAP, CD45, CD11b, CD56, CD3, CD4, CD8, PD1 and CTLA4 and analysed by flow cytometry. Cells were then used fresh for ex vivo T-cell activation and target cell lysis experiments. In some cases, the cells were passaged in DMEM supplemented with 10% FBS for use in later experiments.

Cell Line Maintenance

All cell lines were maintained in DMEM (Sigma-Aldrich, UK) or RPMI medium (Sigma-Aldrich, UK) as specified in Table 3, supplemented with 10% (v/v) foetal bovine serum (FBS, Gibco™) and 1% (v/v) Penicillin/Streptomycin (10 mg/mL, Sigma-Aldrich, UK), in a humidified incubator (MCO-17AIC, Sanyo) at 37° C. and 5% $CO_2$, unless otherwise specified. Cells were split every 2 to 3 days before reaching confluency by enzymatic dissociation with Trypsin/EDTA (0.05% trypsin 0.02% EDTA, Sigma-Aldrich, UK). In this process, culture medium was aspirated and cells were washed with 15 ml of PBS and subsequently cells were treated with 2 mL of Trypsin/EDTA for 2-10 minutes at 37° C. Trypsin was neutralized with 10 mL of DMEM containing 10% FBS and a portion of the cells was transferred into new flasks containing fresh medium. For routine cell culture, media was supplemented with 10% FBS, for infections and virus plasmid transfections with 2% FBS and for recombinant bispecific T-cell activator plasmid transfections with no FBS supplement In a second similar experiment, T-cells were assessed by intracellular cytokine staining 6 hr after co-culture with NHDF cells (200,000 CD3+ cells plus 40,000 NHDF in wells of a 96-well plate) and 300 ng/mL FAP or control bispecific T-cell activators. CD45+ T-cells were intracellularly stained for IFNγ expression with Brefeldin A added into the culture medium 5 hours before harvest. As a positive control, T-cells were stimulated with soluble PMA (10 ng/mL) and ionomycin (1 μg/mL). The results shown in FIG. 4, panel A indicate that the FAP bispecific T-cell activators in the presence of NHDF resulted in a significantly higher number of IFNγ expressing T-cells compared to the control bispecific T-cell activators.

TABLE 3

| Cell line | Origin of cells | Culturing Media | Source |
|---|---|---|---|
| Ascites-derived cell lines | Human primary ascites | DMEM | NHS Blood & Transplant UK |
| BTC100 | Human primary lung cancer-associated fibroblasts (CAF) | DMEM | University of Oxford |
| CHO-K1 | Chinese hamster ovary, adherent | RPMI | ATCC |
| CHO-K1 stable cell lines | Chinese hamster ovary, adherent | RPMI | — |
| DLD1 | Human colorectal adenocarcinoma | RPMI | ATCC |
| HEK 293A | Human embryonic kidney, adherent | DMEM | ATCC |
| HEK 293A stable cell lines | Human embryonic kidney, adherent | DMEM | — |
| HEK 293T | Human embryonic kidney, adherent | DMEM | ATCC |
| MCF-7 | Human, mammary gland, breast, adherent | DMEM | ATCC |
| Normal human dermal fibroblasts (NHDF) | Normal adult human primary dermal fibroblasts | DMEM | ATCC |
| SKOV3 | Human ovarian adenocarcinoma | DMEM | ATCC |

Statistics

In cases where two conditions were being compared, statistical analyses were performed using a t-test. In all other cases, statistical analyses were performed by using a One-way ANOVA.

Characterisation of Human T-Cell Activation by Recombinant FAP Bispecific T-Cell Activator The ability of the FAP bispecific T-cell activators to induce T-cell activation in the presence or absence of normal human dermal fibroblast (NHDF) cells was compared. Human CD3+ T-cells (70,000 cells per well in 96-well U-bottom plates) were co-cultured alone or with NHDF cells (10:1 T:NHDF) in the presence of media alone or 300 ng/mL FAP or control bispecific T-cell activators. Cells were co-cultured for 24 hours at 37° C. and subsequently harvested with enzyme-free cell dissociation buffer (Thermo, #13151014). The expression levels of CD69 (FIG. 3, panel A) and CD25 (FIG. 3, panel B) on CD45+ T-cells were then analysed by antibody staining and flow cytometry and represented as geometric mean fluorescence (gMFI) values. Plate-immobilised anti-CD3 antibody (7.5 μg/mL) was used as positive control for T cell activation. The FAP bispecific T-cell activators selectively induced the expression of activation markers CD69 and CD25 on T-cells, indicating that it was able to activate T cells.

Example 3

A similar set of experiments to those in example 2 were run to characterize the recombinant EpCAM bispecific T-cell activators protein.

Characterisation of human T-cell activation by recombinant EpCAM bispecific T-cell activator The ability of the EpCAM bispecific T-cell activators to induce T-cell activation in the presence or absence of the EpCAM-positive DLD cell line was compared. Human CD3+ T-cells (70,000 cells per well in 96-well U-bottom plates) were co-cultured alone or with DLD cells (10:1 T:DLD) in the presence of media alone or 600 ng/mL EpCAM or control bispecific T-cell activators. Cells were co-cultured for 24 hours at 37° C. and subsequently harvested with enzyme-free cell dissociation buffer. The expression levels of CD69 and CD25 on CD45+ T-cells were then analysed by antibody staining and flow cytometry and data represented as geometric mean fluorescence (gMFI) values. Plate-immobilised anti-CD3 antibody (7.5 μg/mL) was used as positive control for T cell activation. The EpCAM bispecific T-cell activators selectively induced the expression of activation markers CD69 and CD25 on T-cells, indicating that it was able to activate T cells (FIG. 4, panels B & C).

In a similar experiment, T-cells were assessed by intracellular cytokine staining 6 hr after co-culture with DLD cells (200,000 CD3+ T-cells plus 40,000 DLD cells per well of a 96-well plate) and 300 ng/mL EpCAM or control bispecific T-cell activators. CD45+ T-cells were intracellularly stained for IFNγ expression with Brefeldin A added into the culture medium 5 hours before harvest. As a positive control, T cells were stimulated with soluble PMA (10 ng/mL) and ionomycin (1 µg/mL). The results showed that the EpCAM bispecific T-cell activators in the presence of DLD resulted in a significantly higher number of IFNγ expressing T-cells compared to the control bispecific T-cell activators (FIG. 5, panel A).

In another similar experiment, PBMCs from 8 different blood donors were used to evaluate donor-dependent variations in bispecific T-cell activators-mediated T-cell activation. DLD (7,000 cells) were co-cultured with 100,000 PBMC in a U-bottom 96 well plate in the presence of media alone or 300 ng/mL of control or EpCAM bispecific T-cell activators. Cells were co-cultured for 24 hours at 37° C. and subsequently harvested. The expression levels of CD69 and CD25 on CD45+ T-cells were then analysed by antibody staining and flow cytometry and data represented as geometric mean fluorescence (gMFI) values. The results showed that the EpCAM bispecific T-cell activators induced the expression of activation markers CD69 and CD25 in CD3+ T-cells from all 8 donors (FIG. 5, panels B & C).

Example 4

In this example, the ability of recombinant FAP bispecific T-cell activators-activated T-cells to induce death of the fibroblast target cells was evaluated.

Figure 6:
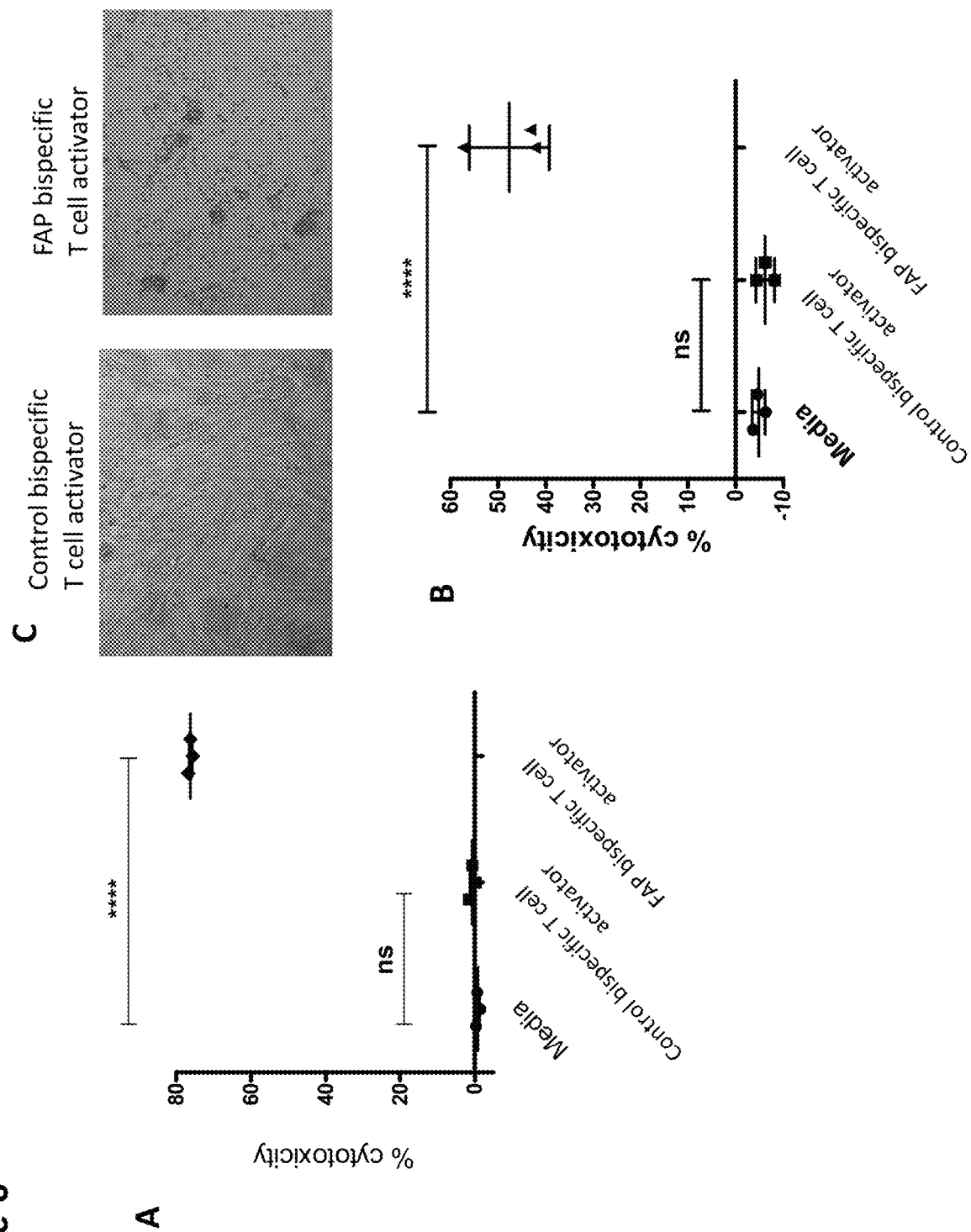
FIG. 6 (A) graph showing the results of a LDH assay showing the cytoxicity of NHDF cells which have been co-cultured with T cells and FAP bispecific T-cell activators or control bispecific T-cell activators. (B) graph showing the results of a LDH assay showing the cytoxicity of BTC100 cells which have been co-cultured with T cells and FAP Bispecific T-cell activators or control bispecific T-cell activators. (C) Images of NHDF cells after co-culture with T cells and FAP bispecific T-cell activators vs control bispecific T-cell activators.

FAP Bispecific T-Cell Activator Induces T Cell-Mediated Lysis of FAP-Positive Cell Lines and Primary Cells NHDF (7,000 cells) were co-cultured with 70,000 T-cells in wells of a U-bottom 96 well plate in the presence of media alone or 300 ng/mL of control or FAP bispecific T-cell activators. After 24 hours of co-culture, supernatants were harvested and cytotoxicity determined by LDH assay following the manufacturer's instructions. The results are in FIG. 6, panel A show that the FAP bispecific T-cell activators significantly increased lysis of NHDF cells.

Figure 7B:
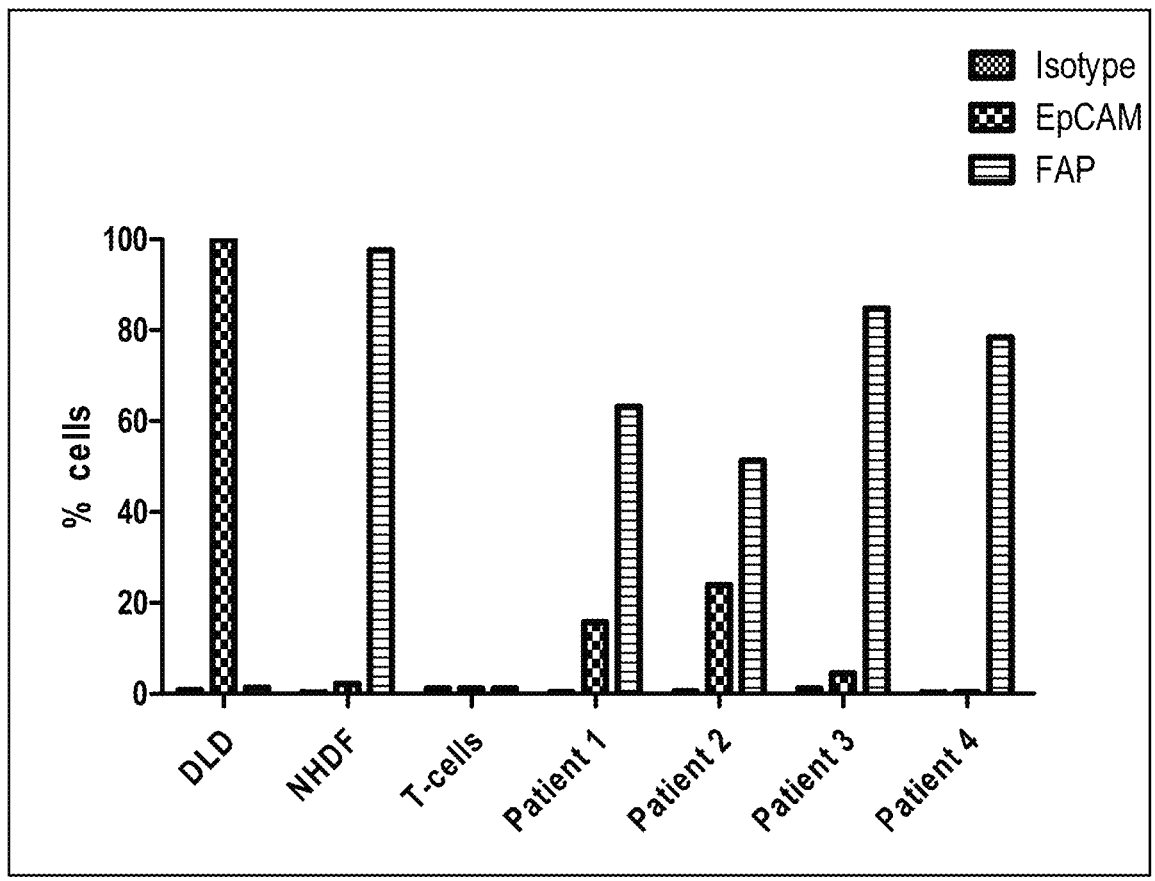

In a similar experiment, 7,000 primary lung fibroblast cells (BTC100) were co-cultured with 70,000 CD3+ T-cells with or without 300 ng/mL of control or FAP bispecific T-cell activators. After 24 hours of co-culture, supernatants were harvested and cytotoxicity determined by LDH assay. The results in FIG. 6, panels B & C show that the FAP bispecific T-cell activators significantly increased lysis of primary human cancer associated fibroblast (CAF) cells. Expression of FAP by these and other patient-derived cell lines is shown in FIGS. 7A and 7B.

The dose-response relationship for FAP bispecific T-cell activators-mediated cell lysis was evaluated by co-culturing 8,000 NHDF cells with 40,000 T-cells and bispecific T-cell activators concentrations ranging from $2\times10^3$ to $2\times10^{-2}$ ng/mL. After co-culture for 24 hours at 37° C., an LDH assay was performed on supernatants to determine target cell cytotoxicity. Dose response curves were fitted using a four parameter non-linear fit model integrated into GraphPad Prism, generating an EC50 value for the FAP bispecific T-cell activators of 3.2 ng/mL. The results (FIG. 8, panel A) show a dose-dependent relationship between FAP bispecific T-cell activators concentration and cytotoxicity as measured by LDH assay (shown as $Abs_{490}$).

Example 5

Similar studies to those in example 4 were used to demonstrate the ability of recombinant EpCAM bispecific T-cell activators-activated T-cells to induce death of target tumour cells was evaluated.

EpCAM Bispecific T-Cell Activator Induces T Cell-Mediated Lysis of EpCAM-Positive Cell Lines DLD tumour cells (7,000 cells) were co-cultured with 70,000 T-cells in wells of a U-bottom 96 well plate in the presence of media alone or 300 ng/mL of control or EpCAM bispecific T-cell activator.

Figure 8:
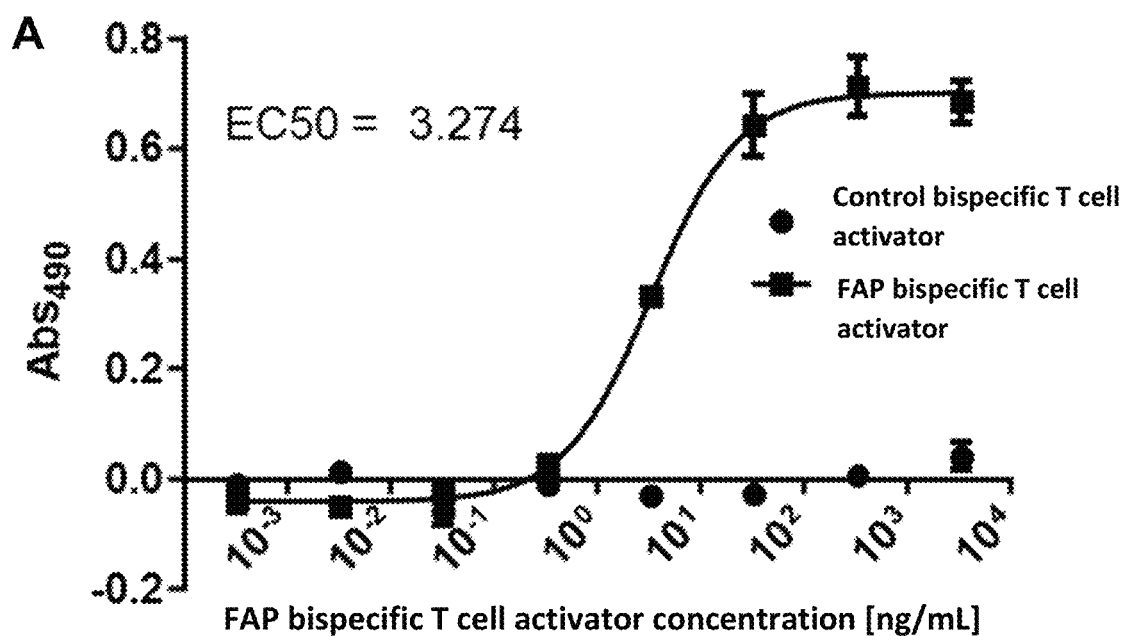
FIG. 8 (A) graph showing the NHDF dose response for FAP bispecific T-cell activators with increasing bispecific T-cell activators concentration. Graph (B) & (C) showing the results of a LDH assay showing the cytoxicity of DLD cells which have been co-cultured with T cells and EpCAM bispecific T-cell activators or control bispecific T-cell activators.

After 24 hours of co-culture, supernatants were harvested and cytotoxicity determined by LDH assay. The results in FIG. 8, panel B show that the EpCAM bispecific T-cell activators significantly increased lysis of DLD cells (EpCAM expression on DLD cells is shown in FIG. 8, panel C).

In a similar experiment, 4,000 SKOV cells were co-cultured with 40,000 CD3+ T-cells with or without 300 ng/mL of control or EpCAM bispecific T-cell activators. After 24 hours of co-culture, supernatants were harvested and cytotoxicity determined by LDH assay. The results in FIG. 9, panel A show that the EpCAM bispecific T-cell activators significantly increased lysis of SKOV cells.

In another similar experiment, 5,000 MCF7 cells were co-cultured with 50,000 CD3+ T-cells with or without 300 ng/mL of control or EpCAM bispecific T-cell activators. After 24 hours of co-culture, supernatants were harvested and cytotoxicity determined by LDH assay. The results in FIG. 9, panel B show that the EpCAM bispecific T-cell activators also significantly increased lysis of MCF7 cells.

Figure 10:
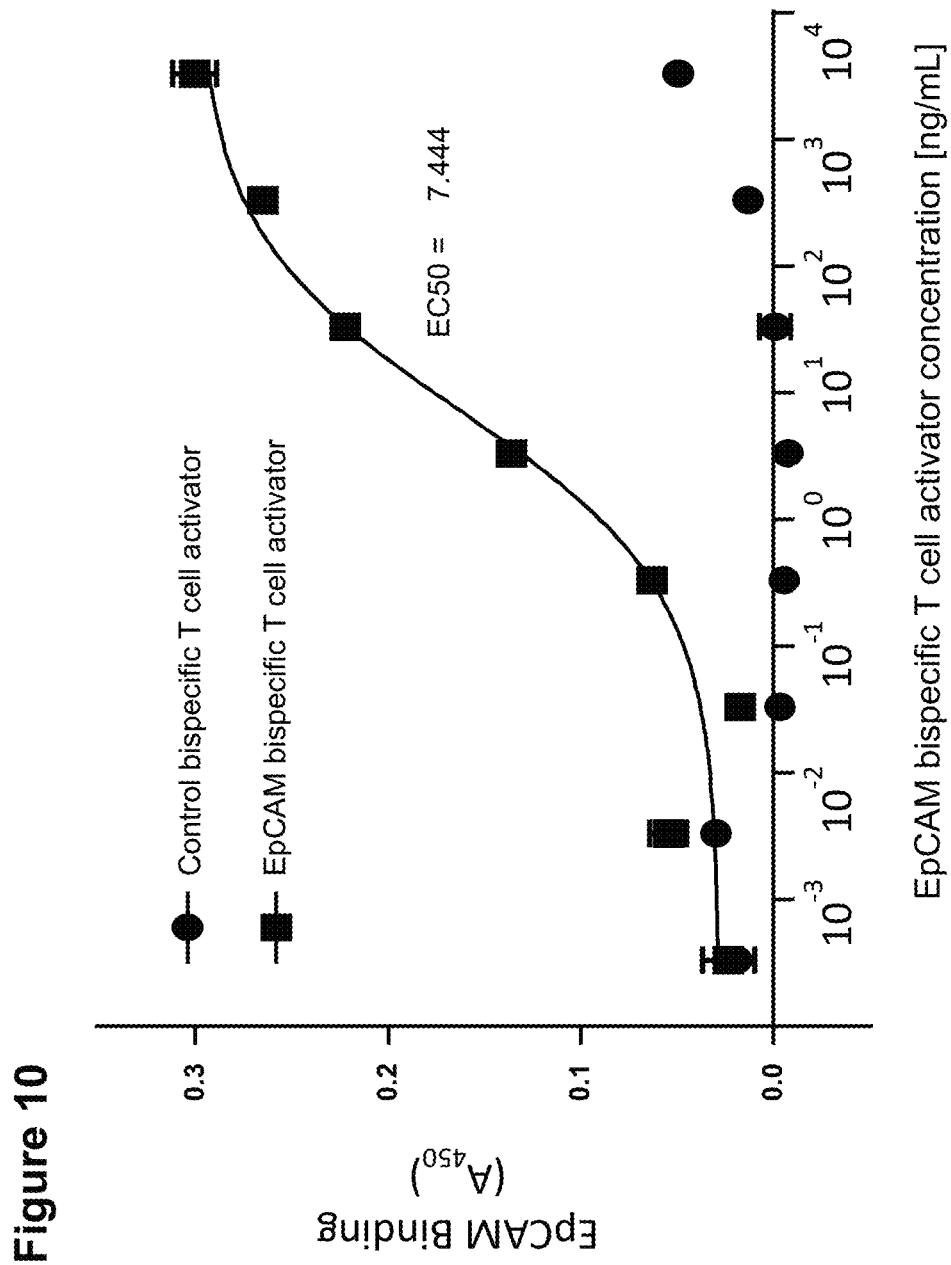
FIG. 10 shows a graph showing the NHDF dose response for EpCAM bispecific T-cell activators with increasing bispecific T-cell activators concentration.

The dose-response relationship for EpCAM bispecific T-cell activator-mediated cell lysis was evaluated by co-culturing 8,000 DLD with 40,000 T-cells and EpCAM or control bispecific T-cell activator concentrations ranging from $2\times10^3$ to $2\times10^{-2}$ ng/mL. After co-culture for 24 hours at 37° C., an LDH assay was performed on supernatants to determine target cell cytotoxicity. Dose response curves were fitted using a four parameter non-linear fit model integrated into GraphPad Prism, generating an EC50 value for the EpCAM bispecific T-cell activator of 7.4 ng/mL. The results in FIG. 10 show a dose dependent relationship between EpCAM Bispecific T-cell activator concentration and cytotoxicity.

In conclusion, the results of this example demonstrate that the EpCAM bispecific T-cell activator was able to induce T-cell mediated lysis of multiple EpCAM-positive tumour cell lines.

Example 6

Stable FAP expressing CHO and Ad293 cell lines were generated as a means to demonstrate the FAP antigen specificity of the FAP bispecific T-cell activator by comparing to parental untransfected cells.

Generation of FAP-Expressing Stable-Transfected Cell Lines

Figure 11:
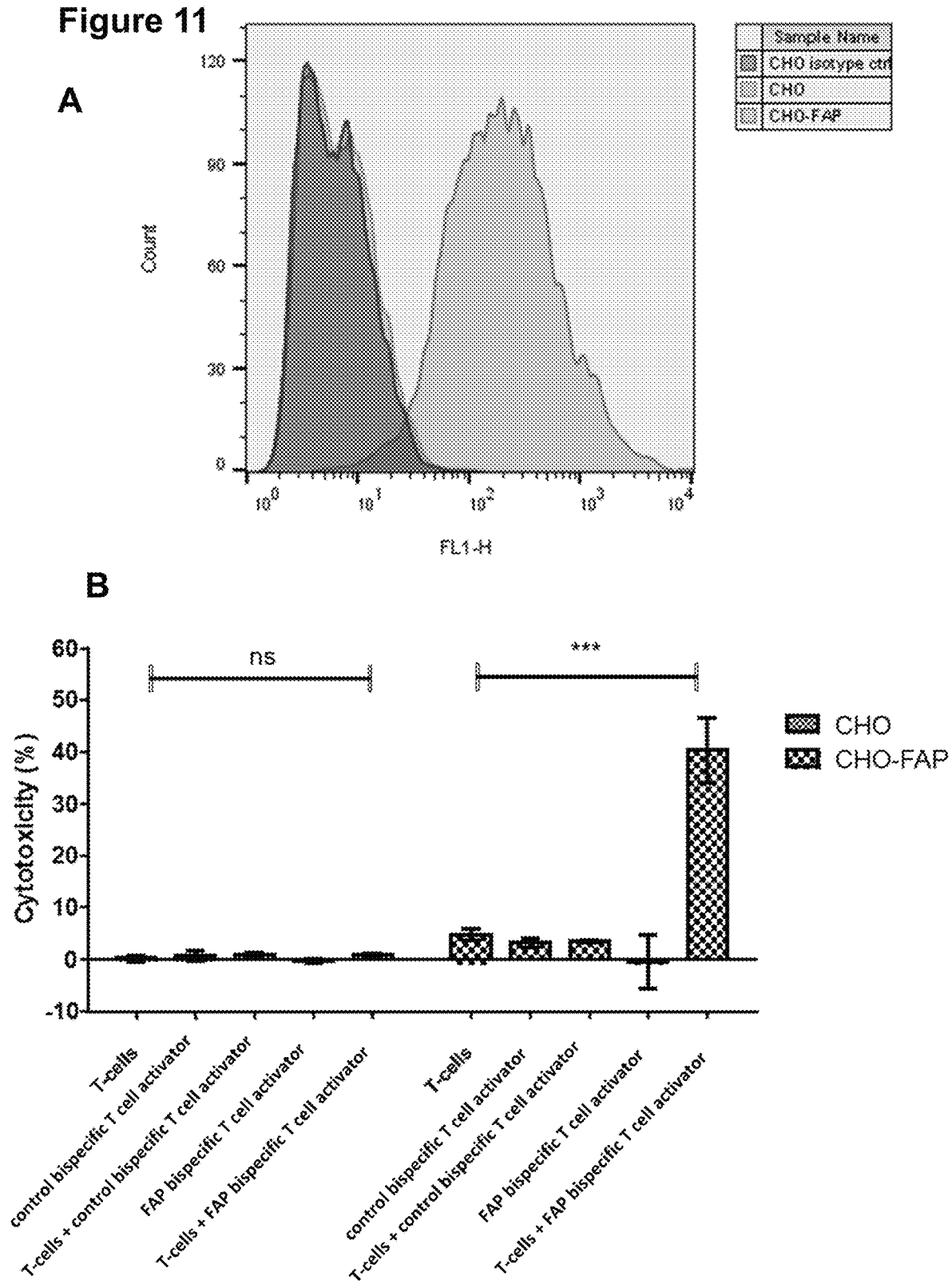
FIG. 11 (A) graph showing FAP expression in CHO cells determined by FAP or isotope control antibody and analysed by flow cytometry. (B) shows a graph showing the results of a LDH assay showing the cytoxicity of CHO or CHO-FAP cells which have been co-cultured with T cells and FAP bispecific T-cell activators or control bispecific T-cell activators.

The protein sequence of the FAP gene was obtained from the NCBI database (SEQ ID 30), reverse transcribed to generate a DNA coding sequence that was synthesised by Oxford Genetics Ltd (Oxford, UK). The FAP gene was cloned into pSF-Lenti vector by standard cloning techniques producing the pSF-Lenti-FAP vector. HEK293T cells were transfected with the lentivirus FAP expression vector alongside pSF-CMV-HIV-Gag-Pol, pSF-CMV-VSV-G, pSF-CMV-HIV-Rev. Lipofectamine 2000 was used as a transfection reagent and was added to the vector DNA at a DNA:lipofectamine ratio of 1:2, and incubated with the cells at 37° C. Supernatant containing lentivirus was harvested 48 hours later and mixed with polybrene (final concentration, 8 µg/mL). The Lentivirus/polybrene mixture was added to seeded Ad293 or CHO cells and incubated at 37° C. On day 4, the supernatant was exchanged for media containing puromycin (2 μg/mL for Ad293 and 7.5 μg/mL for CHO). Stable variants were then clonally selected and FAP expression of the parental cell lines or stable-transfected variant was determined by staining with FAP or isotope control antibody and analysed by flow cytometry (FIG. 11, panel A).
FAP Bispecific T-Cell Activator-Mediated Target Cell Lysis is Specific to FAP-Expressing Cells CHO or CHO-FAP cells (7,000 cells) were co-cultured alone or with human T-cells (70,000) in the presence of media alone or 2 μg/mL control or FAP bispecific T-cell activator in wells of a U-bottom 96-well plate. After 24 hours incubation, supernatants were harvested and target cell cytotoxicity measured by LDH cytotoxicity assay as described in example 4 (FIG. 11, panel B). T-cell activation was also determined by analysing the expression levels of CD69 and CD25 via flow cytometry (FIG. 12). Cytotoxicity was only observed when CHO-FAP cells were cultured with T-cells and FAP bispecific T-cell activators. This indicates that FAP bispecific T-cell activator mediated T-cell activation and target cell lysis is highly specific and limited to FAP-expressing cells, and not the FAP-negative parental cell line.

Example 7

Stable EpCAM expressing CHO amd Ad293 cell lines were generated as a means to demonstrate the EpCAM antigen specificity of the EpCAM bispecific T-cell activator by comparing to parental untransfected cells.
Generation of EpCAM-Expressing Stable-Transfected Cell Lines The protein sequence of the EpCAM gene was obtained from NCBI database (SEQ ID 28), reverse transcribed to generate a DNA coding sequence that was synthesised by Oxford Genetics Ltd (Oxford, UK). The EpCAM gene was cloned into pSF-Lenti vector by standard cloning techniques producing the pSF-Lenti-EpCAM vector. HEK293T cells were transfected with lentivirus EpCAM expression vector alongside pSF-CMV-HIV-Gag-Pol, pSF-CMV-VSV-G, pSF-CMV-HIV-Rev. Lipofectamine 2000 was used as a transfection reagent and was added to the vector DNA at a DNA:lipofectamine ratio of 1:2, and incubated with the cells at 37° C. Supernatant containing lentivirus was harvested 48 hours later and mixed with polybrene (final concentration, 8 μg/mL). The Lentivirus/polybrene mixture was added to seeded Ad293 or CHO cells and incubated at 37° C. On day 4, the supernatant was exchanged for media containing puromycin (2 μg/mL for Ad293 and 7.5 μg/mL for CHO). Stable variants were then clonally selected and EpCAM expression of the parental cell lines or stable-transfected variant was determined by staining with EpCAM or isotope control antibody and analysed by flow cytometry (FIG. 13, panel A).
EpCAM Bispecific T-Cell Activators-Mediated Target Cell Lysis is Specific to EpCAM-Expressing Cells CHO or CHO-EpCAM cells (7,000 cells) were co-cultured alone or with human T-cells (70,000) in the presence of media alone or 21.1 g/mL control or EpCAM bispecific T-cell activator in wells of a U-bottom 96-well plate. After 24 hours incubation, supernatants were harvested and target cell cytotoxicity measured by LDH cytotoxicity assay (FIG. 13, panel B). T-cell activation was also determined by analysing the expressions levels of CD69 and CD25 via flow cytometry (FIG. 14). Cytotoxicity was only observed when CHO-EpCAM cells were cultured with T-cells and EpCAM bispecific T-cell activators. This indicates that EpCAM bispecific T-cell activators mediated T-cell activation and target cell lysis is highly specific and limited to EpCAM-expressing cells, and not the EpCAM-negative parental cell line.

Example 8

Figure 15:
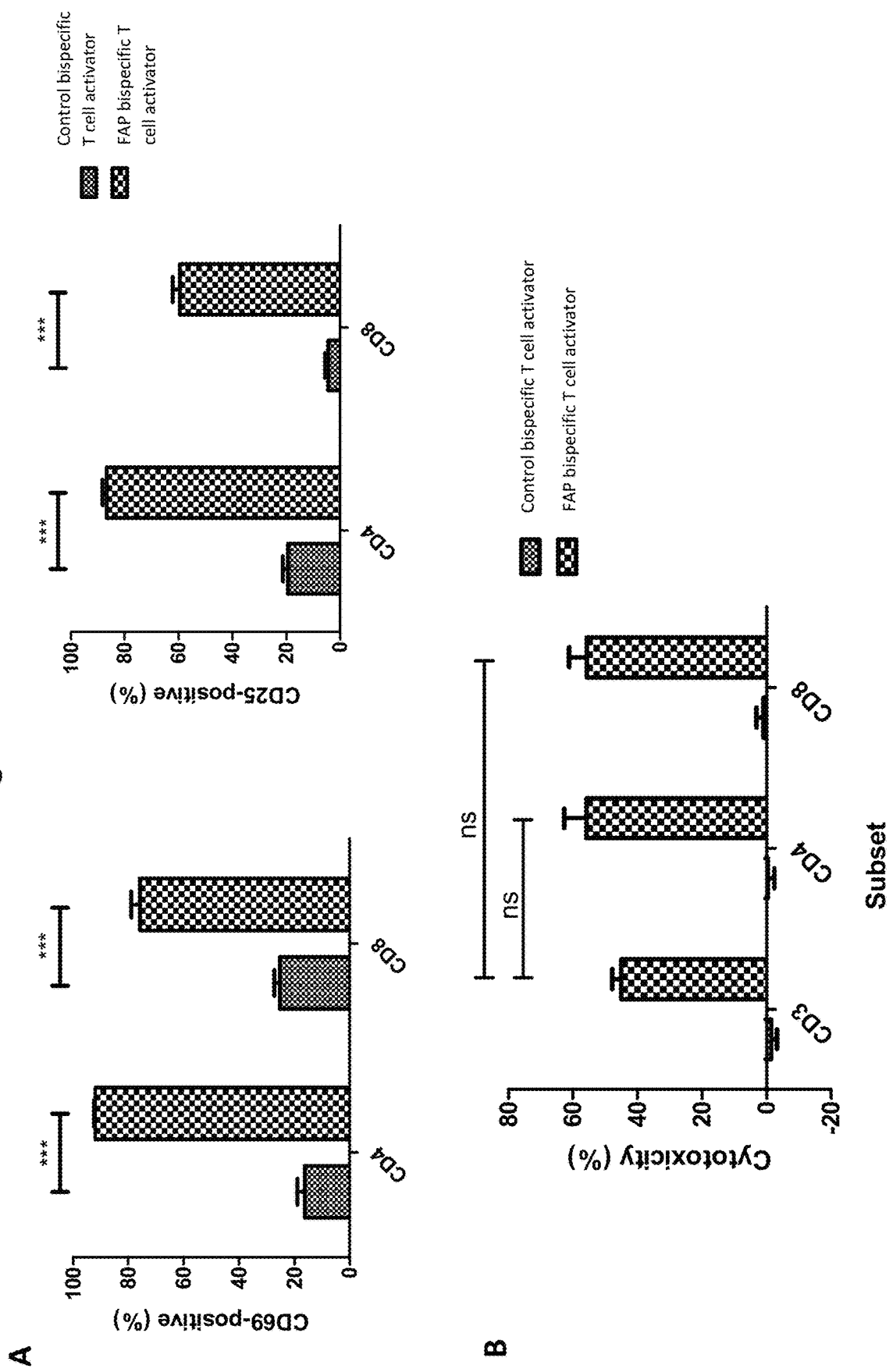
FIG. 15 (A) graph showing the ability of FAP bispecific T-cell activators to activate CD4+ or CD8+ T-cells (based on CD69 and CD25 expression levels), analysed using flow cytometry. (B) graph showing the results of a LDH assay showing the cytoxicity of NHDF cells which have been co-cultured with CD4+ or CD8+ T cells and FAP bispecific T-cell activators or control bispecific T-cell activators.

In a further experiment, the ability of the recombinant FAP bispecific T-cell activator protein to activate CD4 or CD8 T-cells and the ability of each of these T-cell subsets to lyse NHDF cells was assessed. CD3+ T-cells (35,000) were co-cultured with 7,000 NHDF cells in the presence of 300 ng/mL control or FAP bispecific T-cell activator in wells of a U-bottom 96 well plate, and incubated at 37° C. for 24 hours. Cells were harvested and stained with antibodies to CD4 or CD8 and CD69 and CD25, and analysed by flow cytometry. The results (FIG. 15, panel A) demonstrated that the FAP bispecific T-cell activator induced an increase in activation markers CD69 and CD25 in both CD4+ and CD8+ T-cells.

In a similar experiment, the ability of each T-cell subset (CD4 and CD8) to kill target cells was assessed. CD4+ T-cells were extracted from CD3-purified cells by positive selection using a CD4 T Cell Isolation Kit (Miltenyi Biotec, #130-045-101), according to the manufacturer's protocol, with the CD8 cells within non-isolated flow-through. In wells of a U-bottom 96-well plate, 7,000 NHDF were co-cultured with 35,000 CD4+ or CD8+ T-cells together with 300 ng/mL of control or FAP bispecific T-cell activator and incubated at 37° C. After 24 hours, supernatants were harvested and target cell cytotoxicity measured by LDH cytotoxicity assay. The results (FIG. 15, panel B) show that the FAP bispecific T-cell activator induced both CD4+ and CD8+ T-cells to kill NHDF cells.

Example 9

The ability of the EpCAM bispecific T-cell activators to activate CD4+ or CD8+ T-cells and the ability of each subset to lyse DLD tumour cells was assessed. CD3+ T-cells (35,000) were co-cultured with 7,000 DLD cells in the presence of 300 ng/mL control or EpCAM bispecific T-cell activator in wells of a U-bottom 96 well plate, and incubated at 37° C. for 24 hours. Cells were harvested and stained with antibodies for CD4 or CD8 and CD69 and CD25, and analysed by flow cytometry. The results (FIG. 16, panel A) demonstrated that the EpCAM bispecific T-cell activator induced an increase in activation markers CD69 and CD25 in both CD4+ and CD8+ T-cells.

In a similar experiment, the ability of each T-cell subset (CD4 and CD8) to kill target cells was assessed. CD4+ T-cells were extracted from CD3-purified cells by positive selection using CD4 T Cell Isolation Kit according to the manufacturer's protocol, with the CD8 cells within non-selected flow-through. In wells of a U-bottom 96-well plate, 7,000 DLD were co-cultured with 35,000 CD $4^+$ or CD $8^+$ T-cells with 300 ng/mL of control or EpCAM bispecific T-cell activators and incubated at 37° C. After 24 hours, supernatants were harvested and target cell cytotoxicity measured by LDH cytotoxicity assay (FIG. 16, panel B). The results show that the EpCAM bispecific T-cell activator induced both CD4+ and CD8+ T-cells to kill DLD cells.

Example 10

Figure 17:
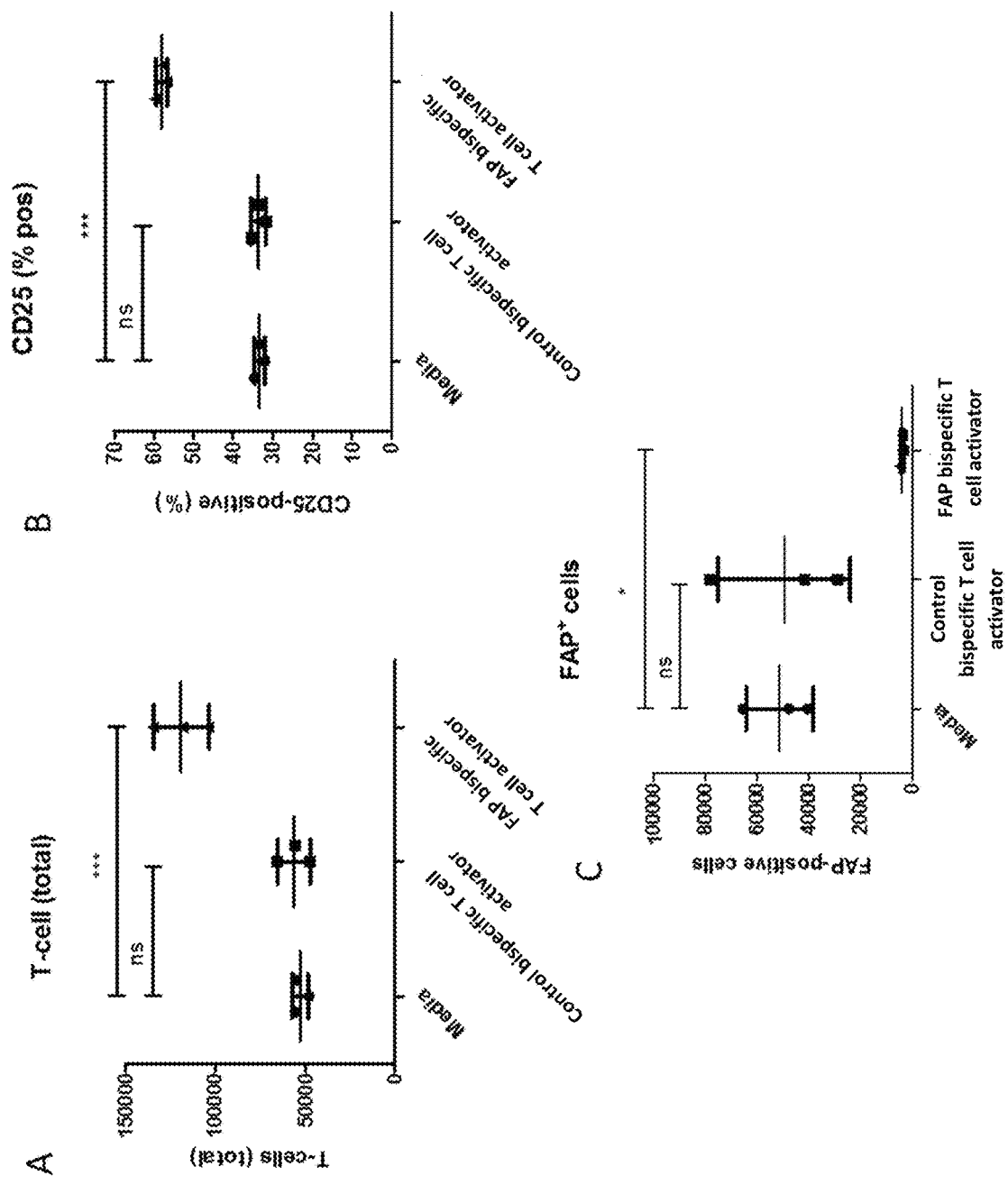
FIG. 17 (A) graph showing the number of CD3+ T cells from ascites cultured with control or FAP bispecific T-cell activators. (B) graph showing the CD25 expression levels of T cells from ascites cultured with control or FAP bispecific T-cell activators. (C) graph showing the number of FAP+ cells from ascites cultured with control or FAP bispecific T-cell activators.

Characterising FAP Bispecific T-Cell Activator-Mediated Activation of Autologous Tumour-Associated Lymphocytes from Primary Malignant Ascites To evaluate the activity of bispecific T-cell activator proteins using cancer patient derived cells, samples of primary malignant ascetic fluids containing both CD3+ T-cells and FAP+ cells were obtained for testing. Unpurified ascites cells (therefore unchanged from when received) were seeded at 250,000 cells per well of a U-bottom 96-well plate in either 100% ascites fluid or medium supplemented with 1% human serum in the presence of 500 ng/mL control or FAP bispecific T-cell activator. Untreated wells served as negative controls. After incubation at 37° C. for 5 days, the total cell population was harvested and the numbers of CD3+ T-cells (FIG. 17, panel A) and expression levels of CD25 on CD3+ T-cells were determined (FIG. 17, panel B). Total cell numbers per well were determined using precision counting beads. The results demonstrate that the FAP bispecific T-cell activators resulted in significant increase in T-cell activation of the tumour-associated T-cells from cancer patients.

As an extension of the experiment above, replicate wells were harvested and the number of FAP+ cells determined by flow cytometry (FIG. 17, panel C). Total cell numbers per well were determined using precision counting beads. The results show that the FAP bispecific T-cell activators resulted in a significant decrease in numbers of autologous FAP-expressing cells in the ascites sample.

Example 11

Recombinant bispecific T-cell activators-expressing EnAd viruses were engineered, produced and purified using the methods described below.

Generation of Bispecific T-Cell Activator-Expressing Enadenotucirev

Figure 18:
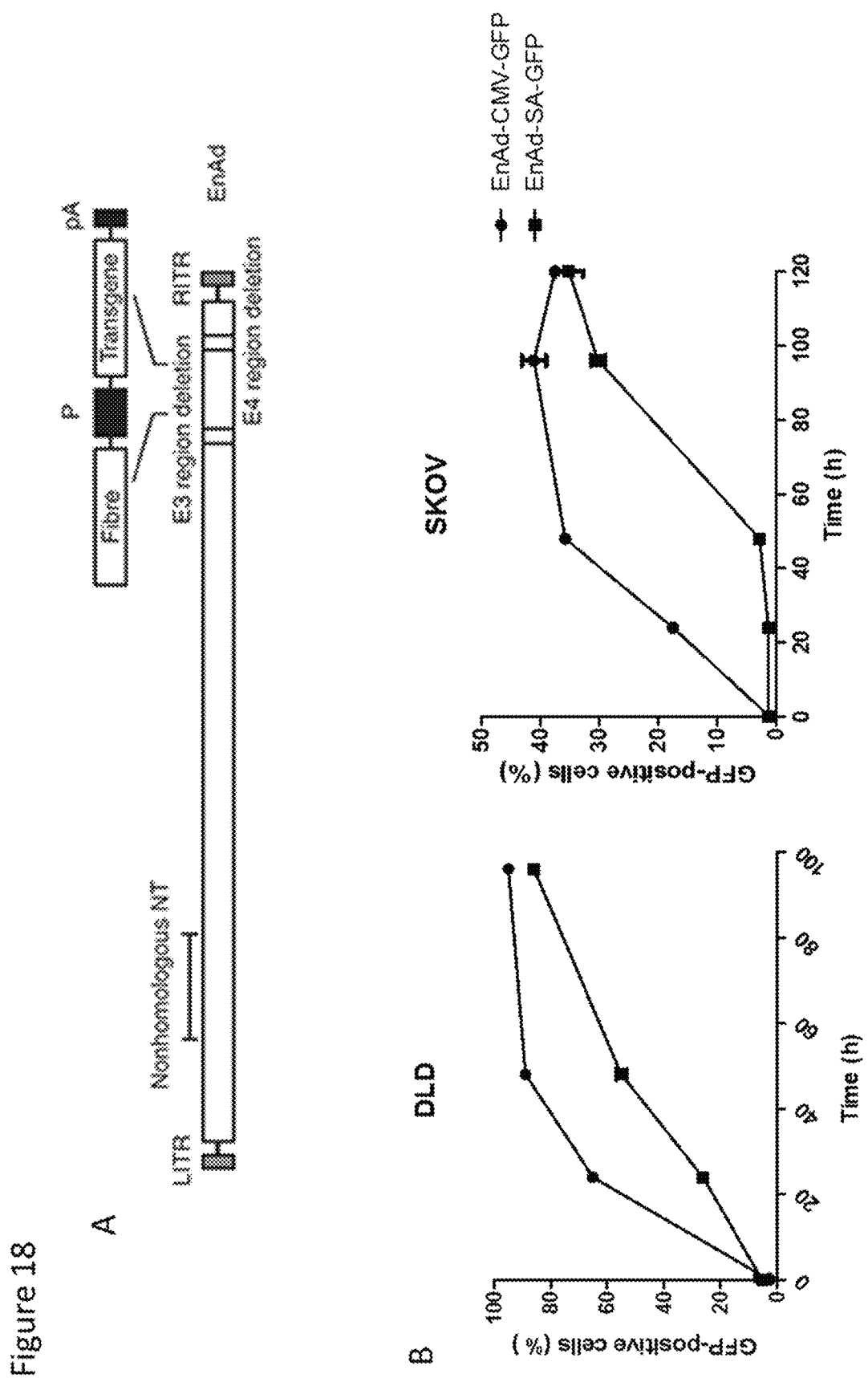
FIG. 18 (A) schematic representation of the genome of the adenoviruses of the present disclosure. (B) graphs comparing the kinetics of CMV vs SA promoter driven expression.

EnAd is a replication competent chimeric group B adenovirus that contains frequent non-homologous nucleotide substitutions of Ad3 for Ad11p in the E2B region, a nearly complete E3 deletion and a smaller E4 deletion mapped to E4orf4 (Kuhn et al, Directed evolution generates a novel oncolytic virus for the treatment of colon cancer, PLoS One, 2008 Jun. 18; 3(6): e2409). A schematic representation of the genome of the adenoviruses used in this study is shown in FIG. 18, panel A.

The plasmid pEnAd2.4 was used to generate the plasmids pEnAd2.4-CMV-EpCAMbispecific T-cell activator, pEnAd2.4-SA-EpCAMbispecific T-cell activator, pEnAd2.4-CMV-FAPbispecific T-cell activator, pEnAd2.4-SA-FAPbispecific T-cell activator, pEnAd2.4-CMV-Controlbispecific T-cell activator, pEnAd2.4-SA-Controlbispecific T-cell activator (Table 4) by direct insertion of a cassette encoding the EpCAM Bispecific T-cell activators (SEQ ID NO: 1), FAP bispecific T-cell activator (SEQ ID NO: 3) or Control bispecific T-cell activator (SEQ ID NO: 5). The transgene cassette contained a 5' short splice acceptor sequence (SEQ ID NO: 33) or an exogenous CMV promoter (SEQ ID NO: 31), the EpCAM, FAP or control bispecific T-cell activator cDNA sequence and a 3' polyadenylation sequence (SEQ ID NO: 32). Construction of the plasmid was confirmed by DNA sequencing. The exogenous CMV promoter is constitutively active and thus leads to early expression of transgenes. The splice acceptor sequence drives expression under the control of the viral major late promoter and leads to later transgene expression following initiation of virus genome replication. The kinetics of this promotor-driven expression can be observed in FIG. 18, panel B, in which GFP was used as the transgene.

TABLE 4

Virus Production and characterisation

| Plasmid ID | [plasmid DNA] ng/ml |
|---|---|
| pEnAd2.4-CMV-EpCAMbispecific T-cell activator | 205.3 |
| pEnAd2.4-SA-EpCAMbispecific T-cell activator | 325.2 |
| pEnAd2.4-CMV-FAPbispecific T-cell activator | 1322.8 |
| pEnAd2.4-SA-FAPbispecific T-cell activator | 3918.3 |
| pEnAd2.4-CMV-Controlbispecific T-cell activator | 189.1 |
| pEnAd2.4-SA-Controlbispecific T-cell activator | 236.2 |
| pEnAd2.4-CMV-FAPbispecific T-cell activator-RFP | 1599 |
| pEnAd2.4-SA-FAPbispecific T-cell activator-RFP | 1872 |
| pEnAd2.4-CMV-Controlbispecific T-cell activator-RFP | 1294 |
| pEnAd2.4-SA-Controlbispecific T-cell activator-RFP | 2082 |

The plasmids EnAd2.4-CMV-EpCAMbispecific T-cell activator, pEnAd2.4-SA-EpCAMbispecific T-cell activator, pEnAd2.4-CMV-FAPbispecific T-cell activator, pEnAd2.4-SA-FAPbispecific T-cell activator, pEnAd2.4-CMV-Controlbispecific T-cell activator, pEnAd2.4-SA-Controlbispecific T-cell activator were linearised by restriction digestion with the enzyme AscI to produce the liner virus genome. Digested DNA was purified by isopropanol extraction and precipitated for 16 hrs, −20° C. in 300 μl >95% molecular biology grade ethanol and 10 μl 3M Sodium Acetate. The precipitated DNA was pelleted by centrifuging at 14000 rpm, 5 mins and was washed in 500111 70% ethanol, before centrifuging again, 14000 rpm, 5 mins. The clean DNA pellet was air dried and resuspended in 1004 water. 6.25 μg DNA was mixed with 15.64 lipofectamine transfection reagent in OptiMEM and incubated for 20 mins, RT. The transfection mixture was then added to a T-25 flask containing Ad293 cells grown to 80% confluency. After incubation of the cells with the transfection mix for 4 hrs at 37° C., 5% $CO_2$ 4 mls of cell media (DMEM high glucose with glutamine supplemented with 10% FBS) was added to the cells and the flasks was incubated 37° C., 5% $CO_2$. The transfected Ad293 cells were monitored every 24 hrs and were supplemented with additional media every 48-72 hrs. The production of virus was monitored by observation of a significant cytopathic effect (CPE) in the cell monolayer. Once extensive CPE was observed the virus was harvested from Ad293 cells by three freeze-thaw cycles. Single virus clones were selected by serial diluting harvested lysate and re-infecting Ad293 cells, and harvesting wells containing single plaques. Serial infections of Ad293 cells were performed once an infection had reached full CPE in order to amplify the virus stocks. Viable virus production during amplification was confirmed by observation of significant CPE in the cell monolayer.

Virus Purification

Once potent virus stocks were amplified the viruses were purified by double caesium chloride density gradient centrifugation (banding) to produce NG-601, NG-602, NG-603, NG-604, NG-605 and NG-606 virus stocks. These stocks were titred by micoBCA assay (Life Technologies), following manufacturer's instructions (Table 5).

TABLE 5

| EnAd ID | NG ID NO: | Virus Genome SEQ ID | vp/mL | TCID50/mL |
|---|---|---|---|---|
| EnAd-CMV-EpCAMbispecific T-cell activator | NG-601 | SEQ ID NO: 34 | $2.2494 \times 10^{12}$ | $1.26 \times 10^{11}$ |
| EnAd-SA-EpCAMbispecific T-cell activator | NG-602 | SEQ ID NO: 35 | $4.21746 \times 10^{12}$ | $1.58 \times 10^{11}$ |
| EnAd-CMV-Controlbispecific T-cell activator | NG-603 | | $1.42607 \times 10^{12}$ | $5.01 \times 10^{10}$ |
| EnAd-SA-Controlbispecific T-cell activator | NG-604 | | $3.31073 \times 10^{12}$ | $2.00 \times 10^{11}$ |
| EnAd-CMV-FAPbispecific T-cell activator | NG-605 | SEQ ID NO: 36 | $1.64653 \times 10^{12}$ | $1.58 \times 10^{11}$ |
| EnAd-SA-FAPbispecific T-cell activator | NG-606 | SEQ ID NO: 37 | $1.28148 \times 10^{12}$ | $3.98 \times 10^{10}$ |
| EnAd-CMV-Controlbispecific T-cell activator-P2A-RFP | NG-607 | | $5.963 \times 10^{12}$ | $1.26 \times 10^{9}$ |
| EnAd-SA-Controlbispecific T-cell activator-P2A-RFP | NG-608 | | $1.51848 \times 10^{12}$ | $6.31 \times 10^{9}$ |
| EnAd-CMV-FAPbispecific T-cell activator-P2A-RFP | NG-609 | | $1.57517 \times 10^{12}$ | $7.94 \times 10^{9}$ |
| EnAd-SA-FAPbispecific T-cell activator-P2A-RFP | NG-610 | | $7.74881 \times 10^{11}$ | $5.01 \times 10^{10}$ |

Example 12

The activities of NG-601, NG-602, NG-603, NG-604, NG-605 and NG-606 viruses were characterised using the methods described below.

Characterisation of Bispecific T-Cell Activator Encoding EnAd Activity Compared to EnAd in Carcinoma Cell Lines The ability NG-601, NG-602, NG-603, NG-604, NG-605, NG-606 or EnAd to replicate was analysed by infection of A549 lung carcinoma cells and assessed by qPCR. A549 cells were seeded in wells of a 24-well plate at a cell density of $2 \times 10^5$ cells/well. Plates were incubated for 18 hrs, 37° C., 5% $CO_2$, before cells were either infected with 100 virus particles per cell (ppc) or were left uninfected. Wells were harvested 24, 48 or 72 hrs post infection and DNA purified using PureLink genomic DNA mini kit (Invitrogen) according to the manufacturer's protocol. Total viral genomes were quantified by qPCR with each extracted sample or standard using an EnAd hexon gene specific primer-probe set in the reaction mix detailed in Table 6. qPCR was performed as per the programme in Table 7.

TABLE 6

| Reagent | Volume/well (µl) |
|---|---|
| 2 × qPCRBIO Probe Mix (PCRBiosystems) | 10 |
| EnAd Forward primer | 0.08 |
| EnAd Reverse primer | 0.08 |
| EnAd Probe | 0.8 |
| NFW | 4.04 |
| Sample | 5 |
| Well Volume | 20 |

TABLE 7

| No. Cycles | Temperature (° C.) | Duration (secs) |
|---|---|---|
| 1 | 95 | 120 |
| 40 | 95 | 5 |
|  | 60-65 | 20-30 |

Figure 19:
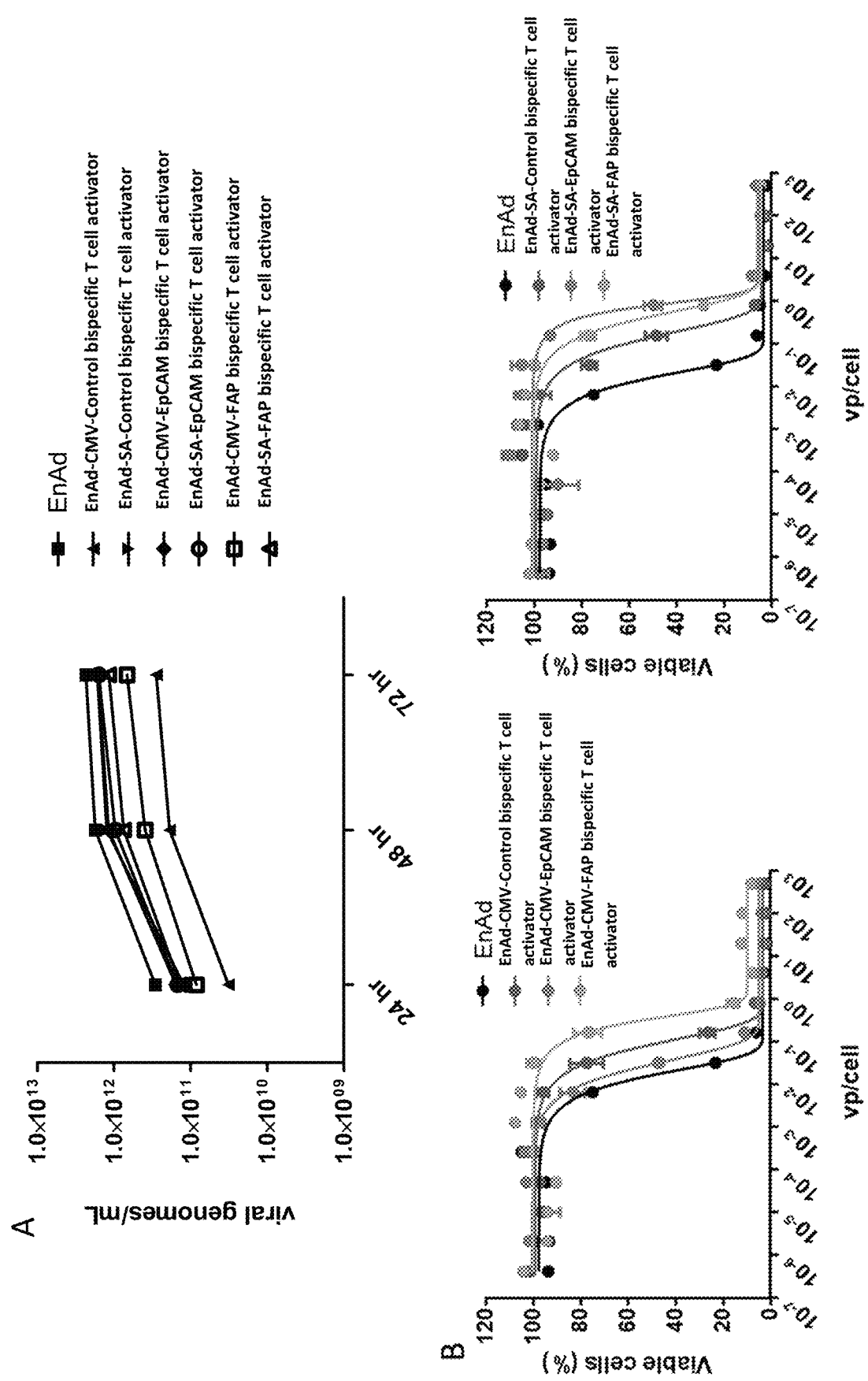
FIG. 19 (A) graph showing the quantification of the number of detected virus genomes per cell for NG-601, NG-602, NG-603, NG-604, NG-605, NG-606 and EnAd. (B) graphs showing the oncolytic activity of NG-601, NG-602, NG-603, NG-604, NG-605, NG-606 or EnAd assessed by infection of A549 cells.

Quantification of the number of detected virus genomes per cell demonstrated that NG-601, NG-602, NG-603, NG-604, NG-605, NG-606 and EnAd virus replication were comparable in the A549 cell line (FIG. 19, panel A).

Oncolytic activity of NG-601, NG-602, NG-603, NG-604, NG-605, NG-606 or EnAd was assessed by infection of A549 (FIG. 19, panel B). A549 cells were seeded in 96-well plate at a cell density of $1.5 \times 10^4$ cells/well. Plates were incubated for 18 hrs, 37° C., 5% $CO_2$, before cells were infected with increasing ppc of virus (5-fold serial dilution, $4.1 \times 10^{-7}$ to 5000 virus ppc) or were left uninfected. A549 cytotoxicity was measured on day 5 by CellTiter 96® AQueous One Solution Cell Proliferation Assay (MTS) (Promega, #G3582). Dose response curves were fitted using a four parameter non-linear fit model integrated into GraphPad Prism. IC50 values generated for each virus demonstrated that the oncolytic activities of NG-601, NG-602, NG-603, NG-604, NG-605, NG-606 and EnAd was comparable for each virus.

Confirmation of Functional Bispecific T-Cell Activator Transgene Expression from NG-601, NG-602, Ng-603, Ng-604, Ng-605, Ng-606

Figure 20:
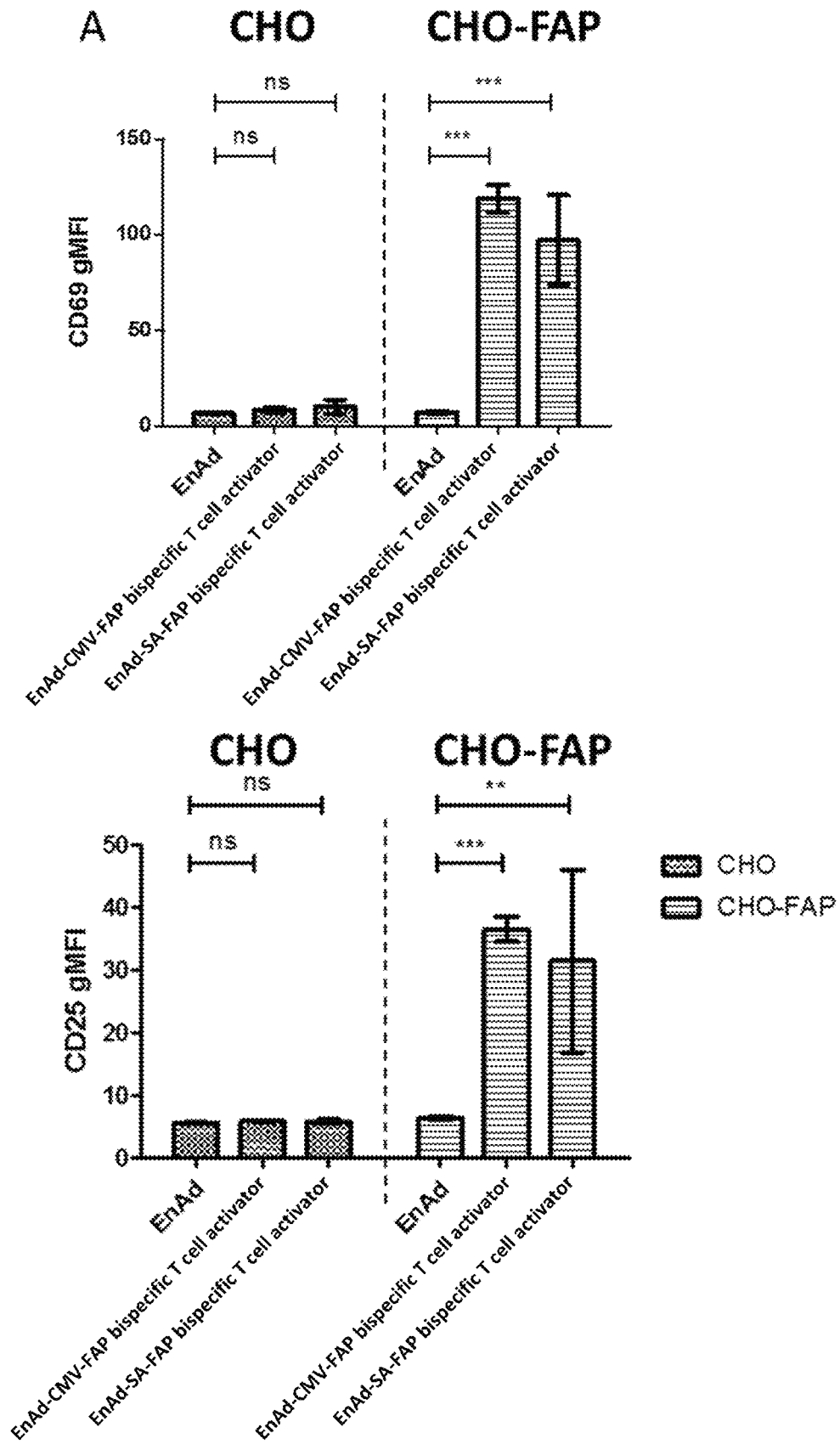
FIG. 20 (A) graphs showing T-cell activation (based on CD69 and CD25 expression levels) by NG-601, NG-602, NG-605 and NG-606 when co-cultured with CHO-FAP, analysed using flow cytometry. (B) graphs showing T-cell activation (based on CD69 and CD25 expression levels) by NG-601, NG-602, NG-605 and NG-606 when co-cultured with CHO-EpCAM, analysed using flow cytometry.

To determine whether the viruses NG-601, NG-602, NG-605, NG-606 produced functional bispecific T-cell activators, T-cell activation assays using CHO, CHO-EpCAM and CHO-FAP cell lines as target cells were performed. 10,000 target cells were co-cultured with 50,000 CD3+ T-cells in wells of a U-bottom 96-well plate with Ad293 viral supernatants diluted 100-fold in culture medium and incubated for 24 hrs, 37° C., 5% $CO_2$. T-cells were harvested and stained with antibodies specific for CD25 and CD69 and analysed by flow cytometry. The results (FIG. 20, panels A and B) indicated that the viruses NG-601 and NG-602 expressed a functional bispecific T-cell activator transgene that activated T cells when co-cultured with CHO-EpCAM cells, and NG-605 and NG-606 expressed a functional bispecific T-cell activator transgene that activated T cells when co-cultured with CHO-FAP cells, but not when co-cultured with CHO cells.

Quantification of Bispecific T-Cell Activator Expression in a Colon Carcinoma Cell Line The quantity of bispecific T-cell activator expression by NG-601, NG-602, NG-605, NG-606 infection of the human colon carcinoma cell line DLD was assessed. DLD cells were seeded in 6 well culture plates at a density of $1.2 \times 10^6$ cells per well. 18 hrs post-seeding, DLD cells were infected with EnAd, NG-601, NG-602, NG-603, NG-604, NG-605, NG-606 at 100 ppc. Cells were cultured for 72 hrs before the supernatants were collected from the wells and centrifuged for 5 mins, 1200 rpm to remove cell debris. The clarified supernatants were then used for a killing assay, with cytotoxicity compared to a standard curve generated with a recombinant bispecific T-cell activator of known concentration, allowing determination of quantity of bispecific T-cell activator in viral supernatants.

Figure 22:
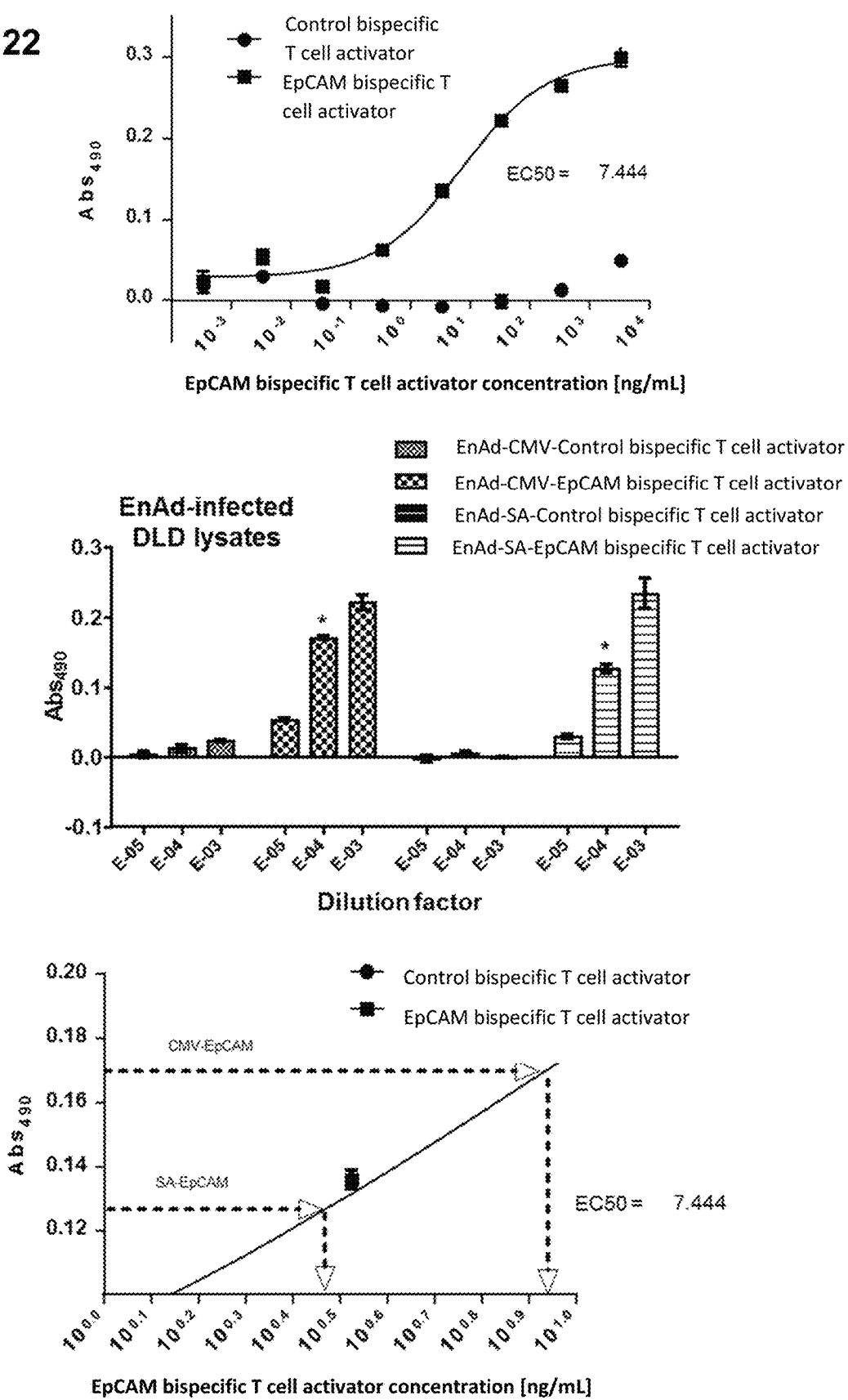
FIG. 22 shows graphs showing the results of experiments to determine the quantity of EpCAMbispecific T-cell activators produced from NG-601 and NG-602.

To determine the quantity of FAP bispecific T-cell activator produced from NG-605 and NG-606, a cytotoxicity assay was performed in which 8,000 NHDF were co-cultured with 40,000 CD3+ T-cells and DLD viral supernatants diluted 1 in $10^3$, 1 in $10^4$ and 1 in $10^5$. A standard curve was generated by incubating NHDF and CD3+ T-cells with FAP or control bispecific T-cell activator at 10-fold serial dilutions from 3333 to $3.33 \times 10^{-4}$ ng/μL. Supernatants were harvested 24 hour post-treatment and cytotoxicity measured by LDH assay. Quantity of bispecific T-cell activator expressed was determined by comparing cytotoxicity of viral supernatants to that of the recombinant bispecific T-cell activator standard curve. The results (FIG. 21) indicated that the viruses NG-605 and NG-606 produced 9.8 and 49.2 μg FAP bispecific T-cell activator per million DLD cells, respectively. To determine the quantity of EpCAM bispecific T-cell activator produced from NG-601 and NG-602, a cytotoxicity assay was performed in which 8,000 DLD cells were co-cultured with 40,000 CD3+ T-cells and DLD viral supernatants diluted 1 in $10^3$, 1 in $10^4$ and 1 in $10^5$. A standard curve was generated by incubating DLD and CD3+ T-cells with EpCAM or control bispecific T-cell activator at 10-fold serial dilutions from 3333 to $3.33 \times 10^{-4}$ ng/μL. Supernatants were harvested 24 hour post-treatment and cytotoxicity measured by LDH assay (FIG. 22). Quantity of bispecific T-cell activator expressed was determined by comparing cytotoxicity of viral supernatants to that of the recombinant bispecific T-cell activator standard curve. The results indicated that the viruses NG-601 and NG-602 produced 165 and 50.3 μg EpCAM bispecific T-cell activator per million DLD cells, respectively.

Example 13

In addition to encoding a FAP or Control bispecific T-cell activator, the NG-607, NG-608, NG-609, NG-610 viruses also carry a red fluorescent protein (RFP) transgene for visualization of infected cells using fluorescent microscopy methods (SEQ ID NOS: 25 & 26, Table 4). The functional activities of these viruses were characterised using the methods described below.

Figure 23:
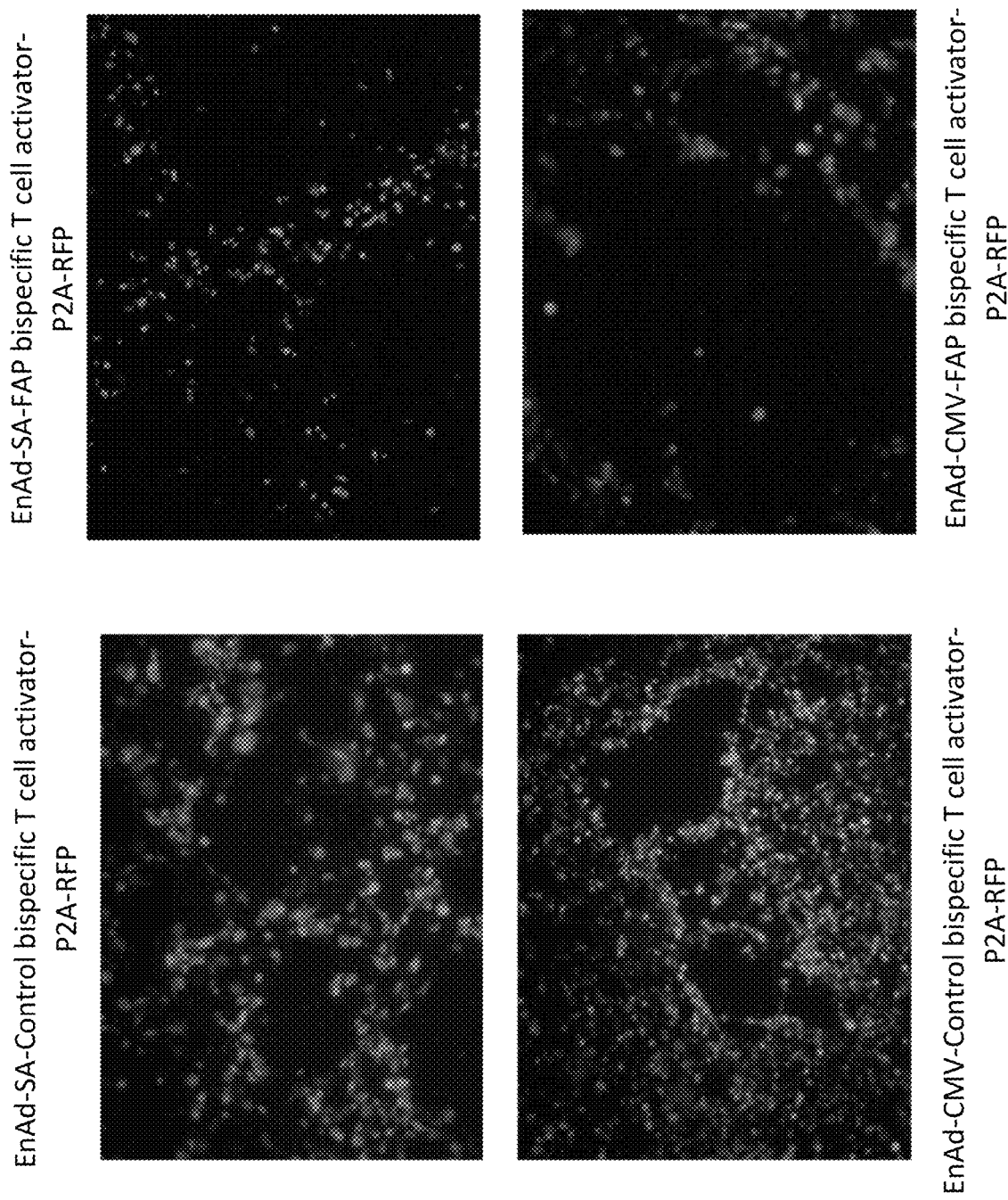
FIG. 23 shows microscopy images of Ad293 cells infected with NG-607, NG-608, NG-609 and NG-610.

Confirmation of transgene expression from NG-607, NG-608, NG-609, NG-610 The ability of viruses NG-607, NG-608, NG-609 and NG-610 to produce their bispecific T-cell activator transgene was assessed by infection of Ad293 cells. Ad293 cells were plated in a 6-well plate at $1 \times 10^6$ cells/well. Plates were incubated for 24 hrs, 37° C., 5% $CO_2$, before cells were infected with viruses at 100 ppc or were left uninfected. At 48 hours post-infection, plaques were irradiated with a fluorescent mercury lamp and photographed (FIG. 23). The results suggested that the viruses NG-607, NG-608, NG-609 and NG-610 express the RFP transgene.

Example 14

In the next series of experiments, the ability of EnAd and FAP or control bispecific T-cell activator viruses NG-603, NG-604, NG-605, NG-606, NG-607, NG-608, NG-609, NG-610 to kill target cells, including tumour cells and fibroblasts, was evaluated.

Figure 24:
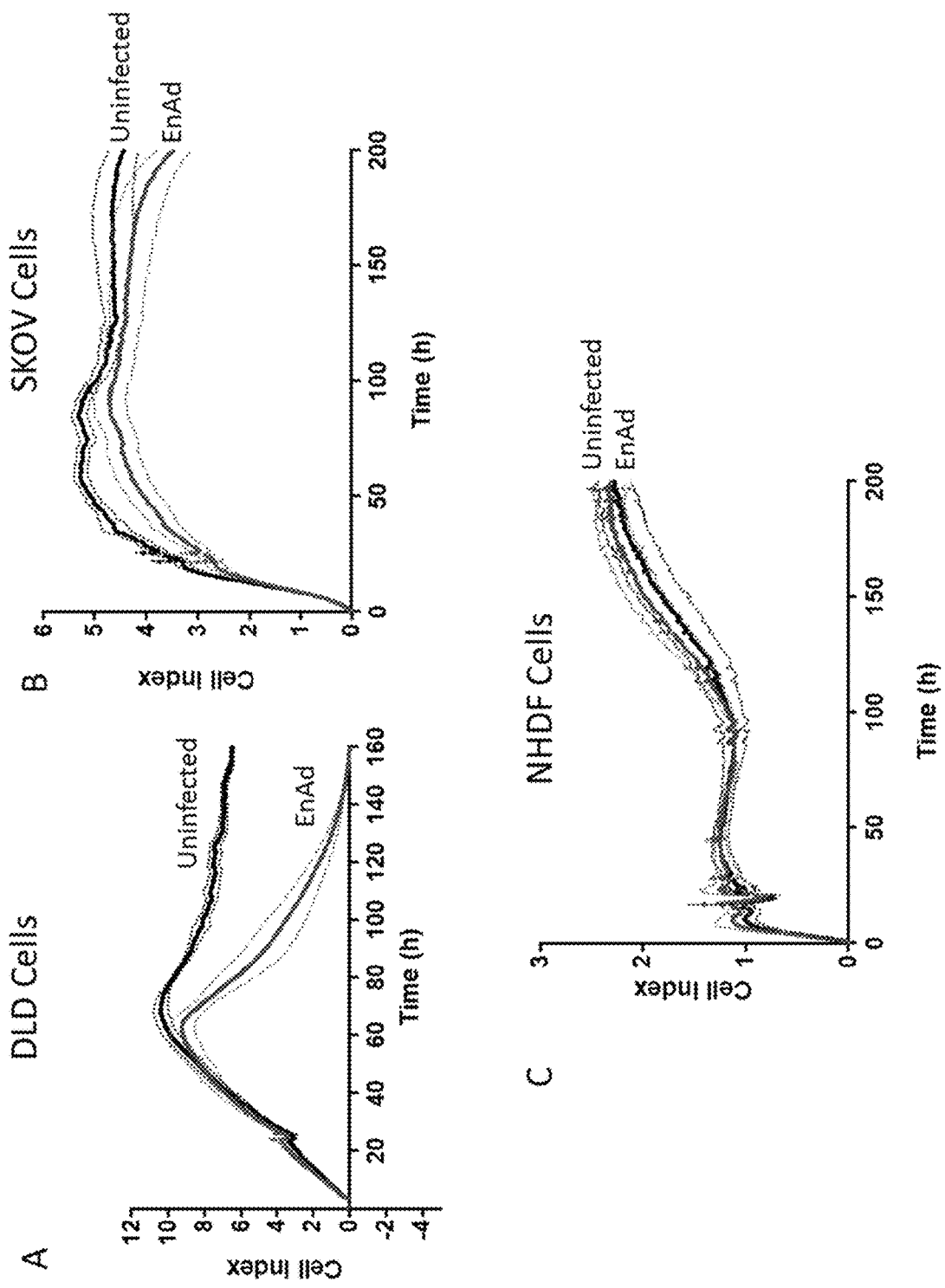
FIG. 24 (A) graph indicating the cytotoxicity of DLD cells infected with EnAd, analysed using XCELLigence. (B) graph indicating the cytotoxicity of SKOV cells infected with EnAd, analysed using XCELLigence. (C) graph indicating the cytotoxicity of NHDF cells infected with EnAd, analysed using XCELLigence.

In the first study, the ability of EnAd to kill DLD cells was assessed using xCELLigence technology. DLD cells were plated in a 48-well E-plate at $1.2 \times 10^4$ cells/well and incubated for 18 hrs, 37° C., 5% $CO_2$, before cells were either infected with 100 EnAd ppc or were left uninfected. XCELLigence was used to measure target cell cytotoxicity every 15 minutes over an 8 day incubation period. The results (FIG. 24, panel A) suggest that EnAd was able to kill DLD cells effectively over the time period.

In a similar experiment, the ability of EnAd to kill SKOV cells was assessed using xCELLigence technology. SKOV cells were plated in a 48-well E-plate at $1 \times 10^4$ cells/well and incubated for 18 hrs, 37° C., 5% $CO_2$, before cells were either infected with 100 EnAd ppc or were left uninfected. xCELLigence was used to measure target cell cytotoxicity every 15 minutes for a period of 8 days. The results (FIG. 24, panel B) suggest that SKOV cells are resistant to EnAd-mediated cytotoxicity over this time frame.

In a similar experiment, the ability of EnAd to kill NHDF cells was also assessed using xCELLigence technology. NHDF cells were plated in a 48-well E-plate at $4 \times 10^3$ cells/well and incubated for 18 hrs, 37° C., 5% $CO_2$, before cells were either infected with 100 EnAd ppc or were left uninfected. xCELLigence was used to measure target cell cytotoxicity every 15 minutes over the same time period as for A549 and SKOV cells. The results (FIG. 24, panel C) suggest that EnAd is unable to kill NHDF cells in the period of time observed.

Figure 25:
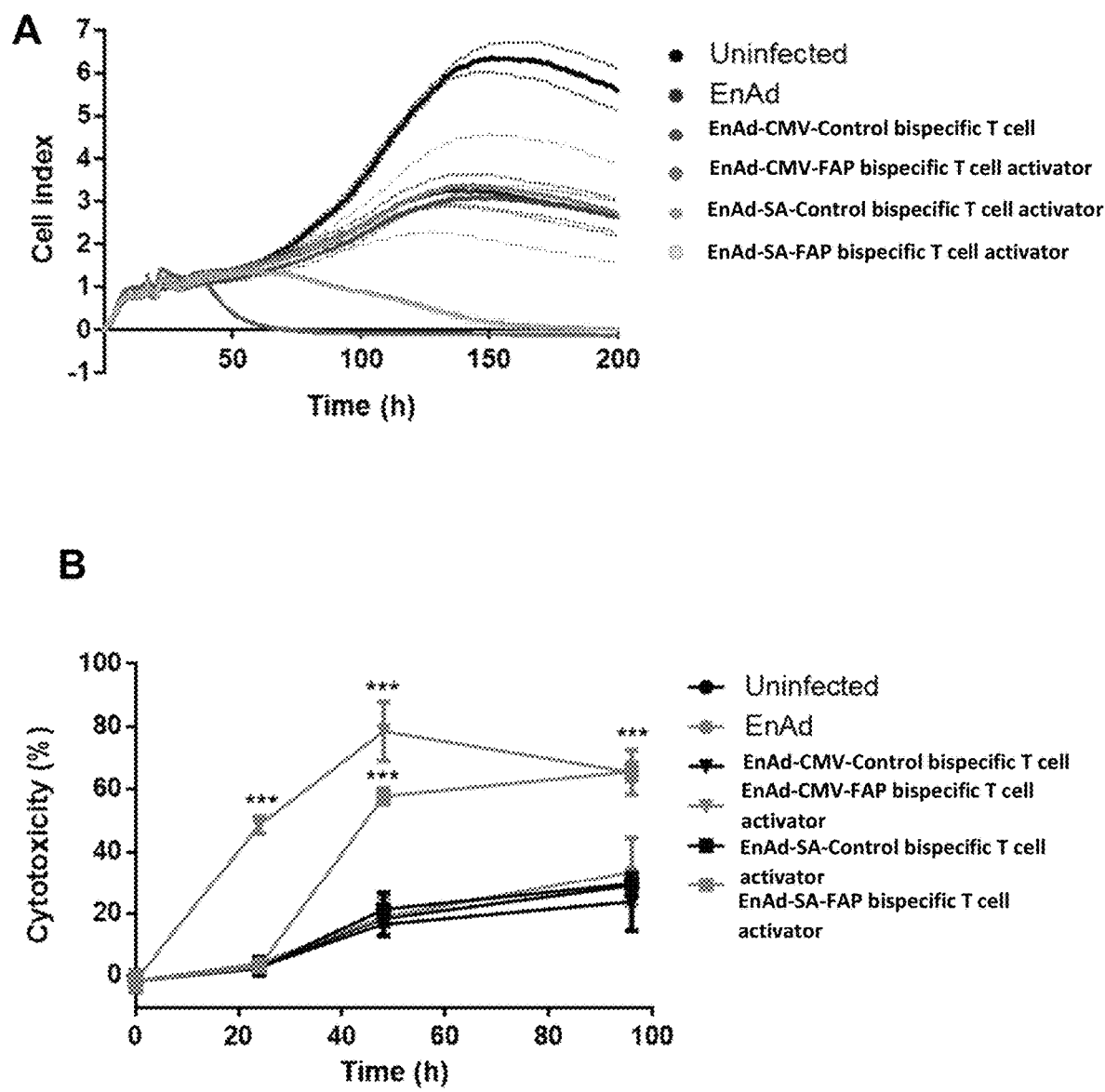
FIG. 25 (A) graph indicating the ability of NG-603, NG-604, NG-605, NG-606 and EnAd to kill NHDF cells, analysed using XCELLigence. (B) graph indicating the ability of NG-603, NG-604, NG-605, NG-606 and EnAd to kill NHDF cells, analysed using an LDH assay.

In a similar experiment, the ability of NG-603, NG-604, NG-605, NG-606 and EnAd to kill NHDF cells was assessed in co-culture with SKOV tumour cells and CD3+ T-cells using xCELLigence. NHDF cells and SKOV cells were seeded in a 48-well E-plate at $4 \times 10^3$ and $1 \times 10^3$ cells/well, respectively. Plates were incubated for 18 hrs, 37° C., 5% $CO_2$, before cells were either infected with 100 ppc of EnAd, of NG-603, NG-604, NG-605 or NG-606 or were left uninfected. After 2 hour incubation, 37,500 $CD3^+$ T-cells were added to each well. xCELLigence was used to measure target cell cytotoxicity every 15 minutes. The results (FIG. 25, panel A) demonstrate that the FAP bispecific T-cell activator-expressing viruses NG-605 and NG606, but not EnAd or control bispecific T-cell activator-expressing viruses NG-603 and NG-604, were able to induce lysis of NHDF cells, with kinetics dependent on the promoter used for bispecific T-cell activator expression (faster with CMV promoter).

In a similar experiment, the ability of NG-603, NG-604, NG-605, NG-606 and EnAd to kill NHDF cells, was assessed in co-culture with SKOV and CD3+ T-cells using LDH cytotoxicity assay. NHDF cells and SKOV cells were seeded in a 96-well U-bottom plate at $8 \times 10^3$ and $2 \times 10^3$ cells/well, respectively, and either infected with 100 ppc of EnAd, of NG-603, NG-604, NG-605 or NG-606 or were left uninfected. After 2 hour incubation, 75,000 CD3+ T-cells were added to each well and plates were incubated at 37° C., 5% $CO_2$. Supernatants were harvested at 0, 24, 48 and 96 hours post-treatment and cytotoxicity measured by LDH cytotoxicity assay. The results (FIG. 25, panel B) demonstrate that the FAP bispecific T-cell activator-expressing viruses NG-605 and NG606, but not EnAd or control bispecific T-cell activator-expressing viruses NG-603 and NG-604, were able to induce lysis of NHDF cells, with kinetics dependent on the promoter used for bispecific T-cell activator expression.

Figure 26:
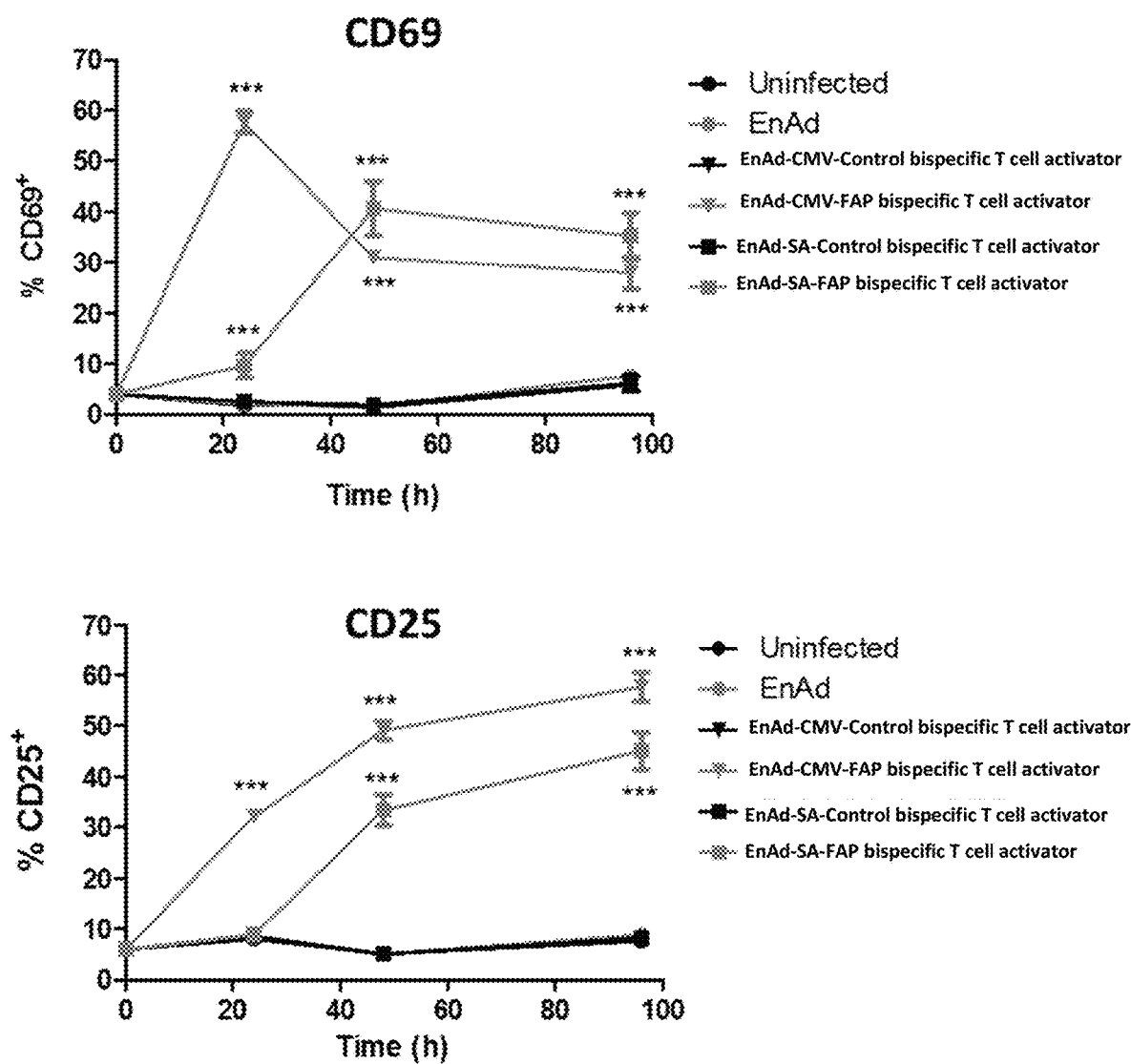
FIG. 26 shows graphs showing T-cell activation (based on CD69 and CD25 expression levels) by NG-603, NG-604, NG-605, NG-606 co-cultured with NHDF cells, SKOV and T cells, analysed using flow cytometry.

As an extension of the LDH experiment above, the cells were also harvested at 0, 24, 48 and 96 hours post-treatment, stained with antibodies for CD45, CD69 and CD25 and analysed by flow cytometry. The results (FIG. 26) demonstrate that the FAP bispecific T-cell activator-expressing viruses NG-605 and NG-606, but not EnAd or control bispecific T-cell activator-expressing viruses NG-603 and NG-604, were able to induce T-cell activation, with kinetics dependent on the promoter used for bispecific T-cell activator expression.

Figure 27:
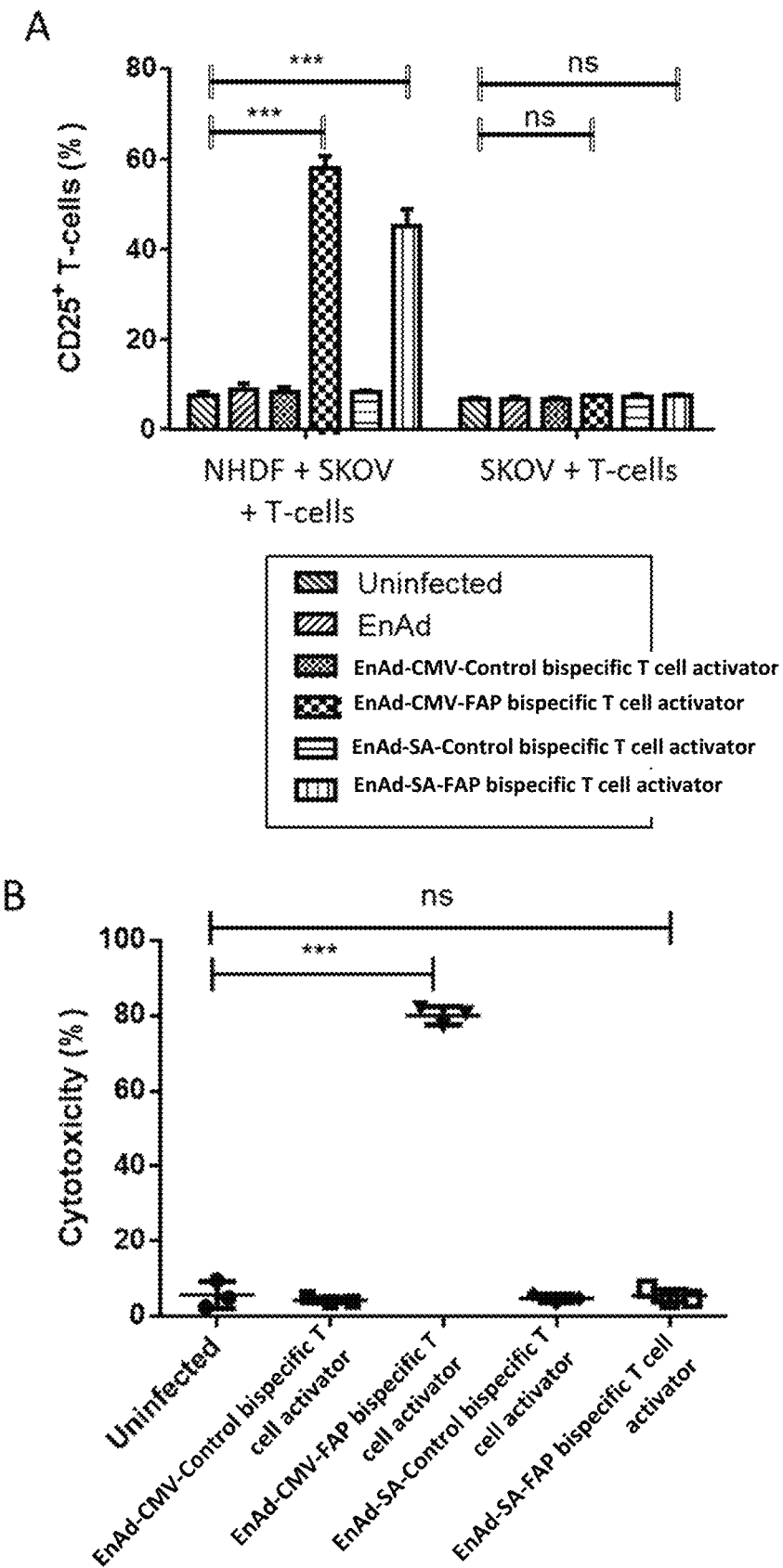
FIG. 27 (A) graph showing T-cell activation (based on CD69 and CD25 expression levels) by NG-603, NG-604, NG-605, NG-606 co-cultured with NHDF and SKOV cells vs. SKOV alone, analysed using flow cytometry. (B) graph indicating the cytotoxicity of NHDF cells infected with NG-605 and NG-606, analysed using an LDH assay

In a similar experiment, the dependence on FAP to induce FAP bispecific T-cell activator-mediated T-cell activation was evaluated. In a 96-well U-bottom plate, SKOV cells were seeded at $2\times10^3$ cells/well alone or in combination with NHDF cells at $8\times10^3$ cells/well. Viral particles were added to each well at 100 ppc, and plates incubated at 37° C., 5% $CO_2$. After two hours, 75,000 CD3+ T-cells were added and plates incubated further. At 96-hours post-infection, cells were harvested and stained for CD45 and CD25 and analysed by flow cytometry (FIG. 27, panel A). The results demonstrate that the FAP bispecific T-cell activator-expressing viruses NG-605 and NG-606, only induced T-cell activation in the presence of FAP-positive NHDF cells.

In a similar experiment, the specificity of promoter (CMV or virus MLP/SA)-driven bispecific T-cell activator expression in NG-605 and NG-606 was investigated further. In a 96-well U-bottom plate, NHDF cells were seeded at $4\times10^3$ cells/well. 100 viral particles per cell were added to each well, and plates incubated at 37° C., 5% $CO_2$. After two hours, 40,000 CD3 cells were added and plates incubated further. At 72-hours post-infection, supernatants were harvested and cytotoxicity measured by LDH cytotoxicity assay. The results (FIG. 27, panel B) demonstrate that the CMV-driven virus NG-605, but not SA-driven NG-606, was able to mediate killing of NHDF cells upon infection of NHDF cells alone. The results indicate that NG-605 and NG-606 were both able to induce T cell activation and target cell lysis, although the kinetic profile was slightly different depending on the promoter used.

Figure 28:
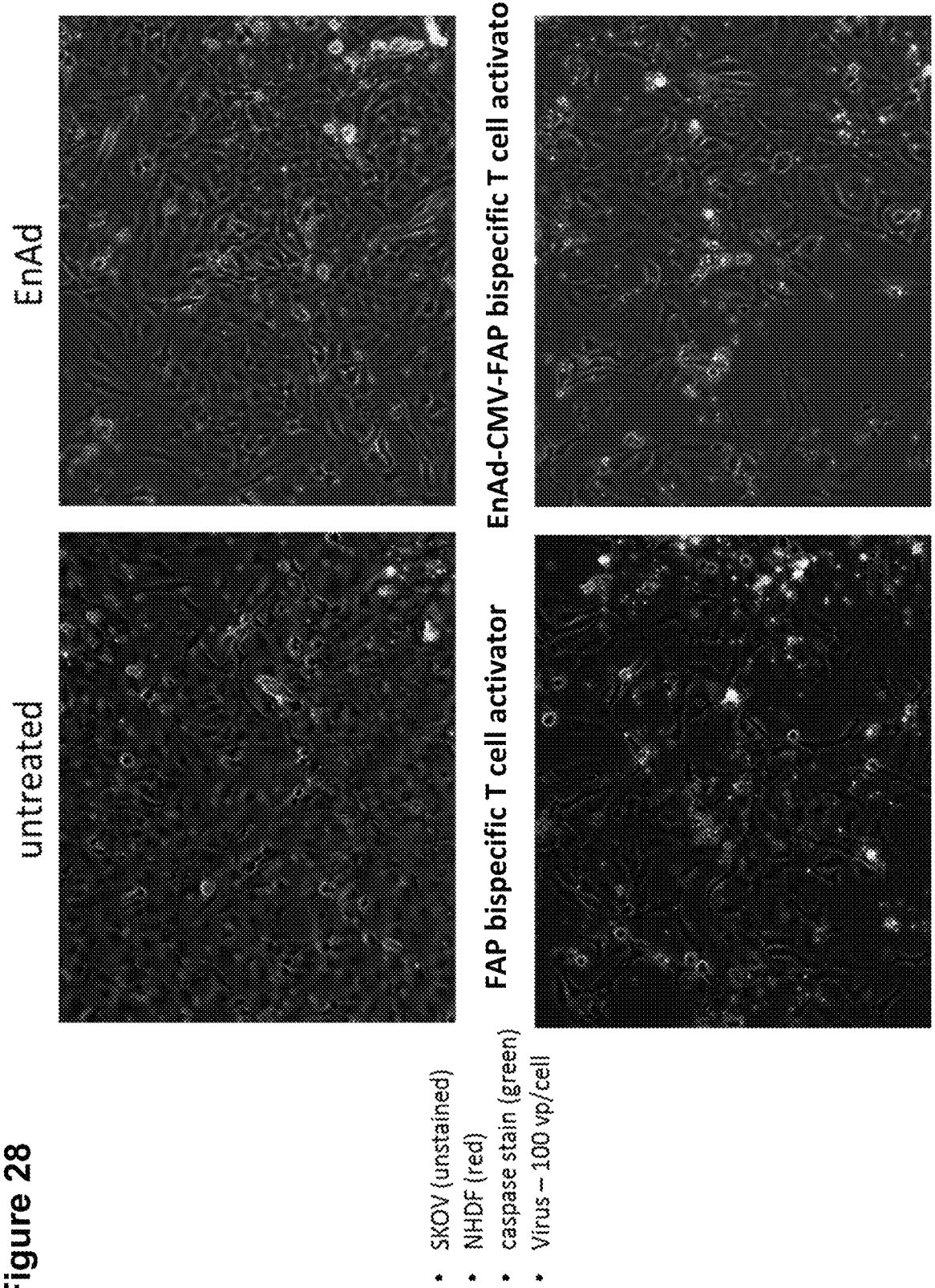
FIG. 28 shows still frame images from timelapse videos of lysis of NHDF cells by recombinant FAP bispecific T-cell activators, EnAd, NG-603 or NG-605.

Timelapse videos were obtained to observe viral or T cell-mediated lysis of target cells by recombinant FAP bispecific T-cell activator, EnAd, NG-603 or NG-605. NHDF cells were stained with CellTracker Orange CMTMR Dye (Life Tech, #C2927) and CD3+ T-cells were stained with CellTrace Violet Cell Proliferation Kit (Life Tech, #C34557) following manufacturer's protocols. Dyed NHDF were plated in a 24-well plate at $7.5\times10^3$ cells/well in co-culture with $1.35\times10^4$ DLD or SKOV tumour cells. Plates were incubated for 18 hrs, 37° C., 5% $CO_2$. Cells were then treated with 300 ng/mL FAP bispecific T-cell activator or infected with 100 ppc of EnAd, NG-603, and NG-605 or left untreated. After two hours incubation, 100,000 dyed CD3+ T-cells were added to necessary wells, in addition to 1.5 µM CellEvent Caspase 3-7 reagent (Life Tech, #C10423). Videos were obtained on a Nikon TE 2000-E Eclipse inverted microscope, with images captured every 15 minutes for 96 hours. Frames from the videos are shown in FIG. 28. The results show that the recombinant FAP bispecific T-cell activator and NG-605, but not EnAd or NG-603, were able to induce rapid lysis of NHDF cells. In a similar experiment, NHDF cells were stained with CellTracker Green CMFDA Dye (Life Tech, #C2925) and CD3+ T-cells were stained with CellTrace Violet Cell Proliferation Kit (Life Tech, #C34557) following manufacturer's protocols. Dyed NHDF were plated in a 24-well plate at $7.5\times10^3$ cells/well in co-culture with $1.35\times10^4$ DLD or SKOV tumour cells. Plates were incubated for 18 hrs, 37° C., 5% $CO_2$. Cells were then infected with 100 ppc of NG-607, NG-608, NG-609 or NG-610 or left uninfected. After two hours incubation, 100,000 dyed CD3+ T-cells were added to necessary wells. Videos were obtained on a Nikon TE 2000-E Eclipse inverted microscope, with images captured every 15 minutes for 96 hours. Frames from the videos are shown in FIG. 29. The results show that all viruses lead to tumour cell infection (RFP, red fluorescence, positive), but only NG-609 and NG-610 were able to induce rapid lysis of the co-cultured NHDF cells.

Example 15

In this series of experiments, the ability of EnAd and EpCAM or control bispecific T-cell activator viruses NG-601, NG-602, NG-603 and NG-604 to kill target cells, including tumour cells and fibroblasts, was evaluated.

Characterisation of Human T-Cell Activation and EpCAM-Positive Target Cell Lysis by EnAd, NG-601, NG-602, NG-603 and NG-604

Figure 30:
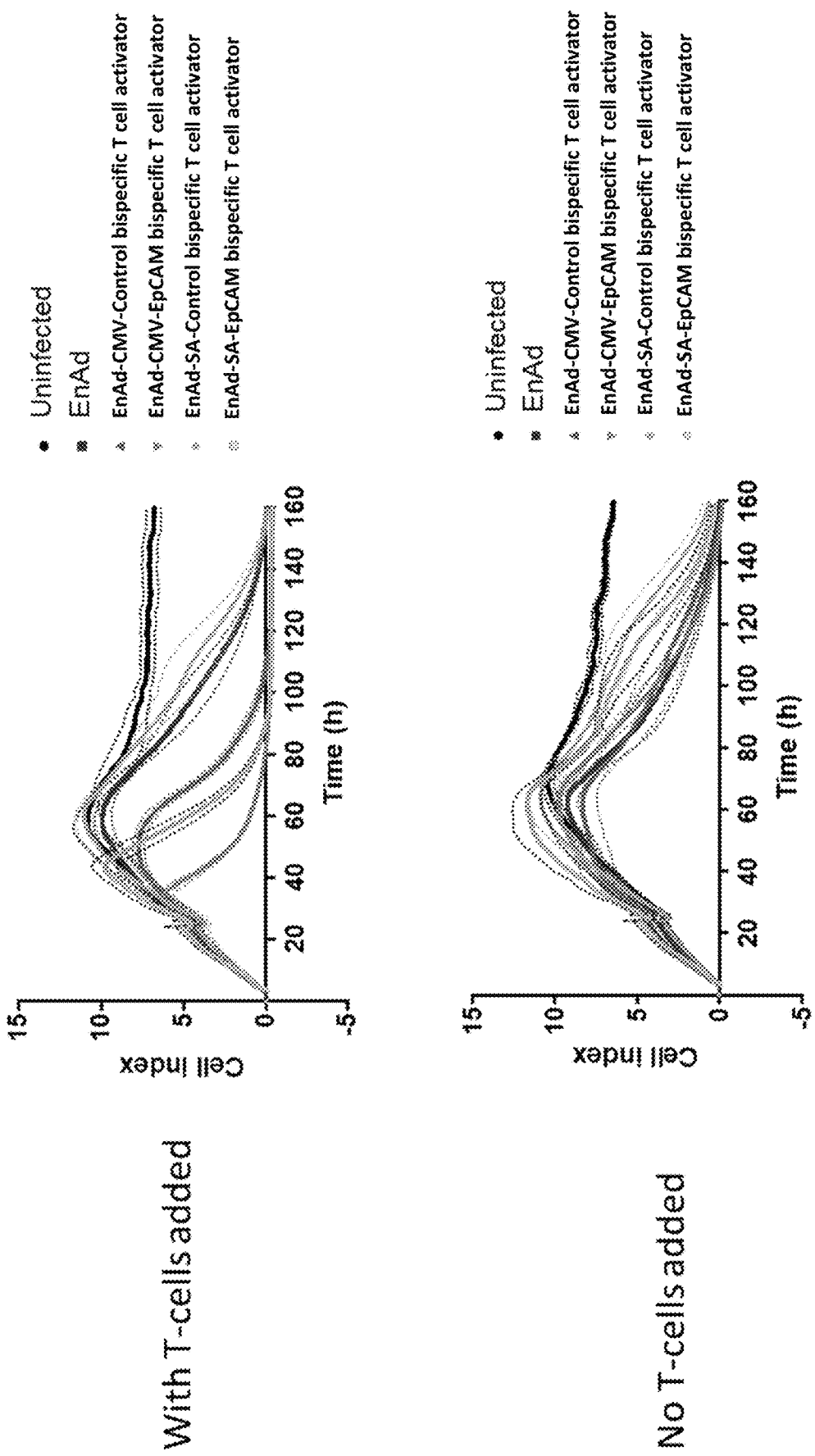
FIG. 30 shows a graph indicating the cytotoxicity of DLD cells infected with EnAd, NG-601, NG-602, NG-603 and NG-604 in the presence of T cells or absence of T cells, analysed using XCELLigence.

The ability of EnAd and NG-601, NG-602, NG-603 and NG-604 to kill DLD tumour cells in the presence or absence of CD3+ T-cells was assessed using xCELLigence technology. DLD cells were plated in 48-well E-plate at $1.2\times10^4$ cells/well. Plates were incubated for 18 hrs, 37° C., 5% $CO_2$, before cells were either infected with EnAd at 100 ppc or were left uninfected. Two hours after infection, 75,000 CD3+ T-cells were added to the necessary wells. XCELLigence was used to measure target cell cytotoxicity every 15 minutes. The results (FIG. 30) demonstrate that NG-601 and NG-602 lead to significantly more rapid DLD cytotoxicity in a T cell-dependent manner.

Figure 31:
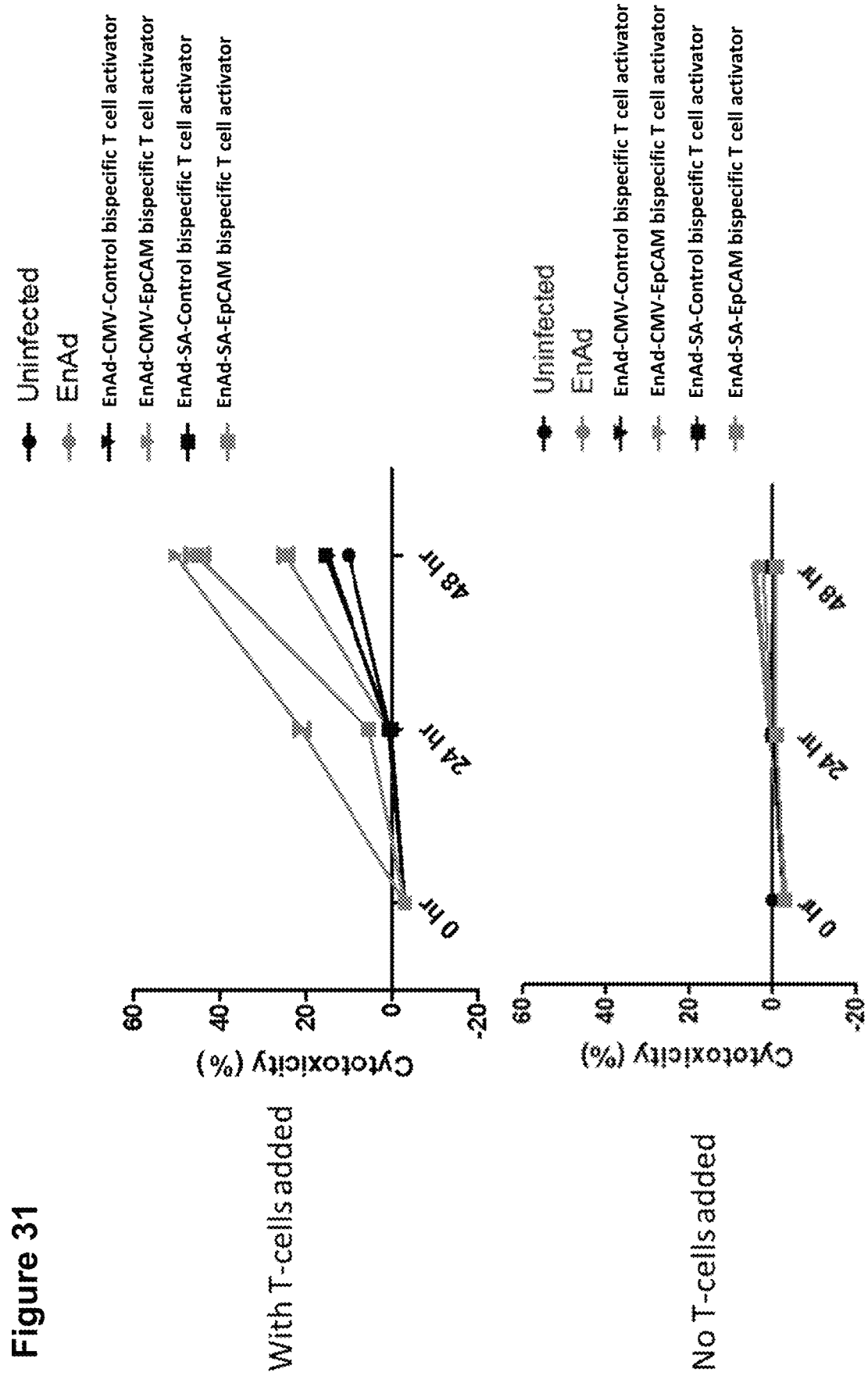
FIG. 31 shows a graph indicating the cytotoxicity of DLD cells infected with EnAd, NG-601, NG-602, NG-603 and NG-604 in the presence of T cells or absence of T cells, analysed using an LDH assay.

In a similar experiment, the ability of EnAd and NG-601, NG-602, NG-603 and NG-604 to kill DLD tumour cells in the presence or absence of CD3+ T-cells was assessed using LDH cytotoxicity assay. DLD cells were plated in a 96-well U-bottom plate at $2\times10^4$ cells/well and either infected with 100 ppc EnAd or were left uninfected. Two hours after infection, 150,000 CD3+ T-cells were added to the necessary wells. Plates were incubated at 37° C., 5% $CO_2$ and supernatant harvested and analysed by LDH cytotoxicity assay at 0, 24, 48 and 72 hours post-infection. The results (FIG. 31) demonstrate that NG-601 and NG-602 lead to more rapid DLD cytotoxicity in a T cell-dependent manner.

Figure 32:
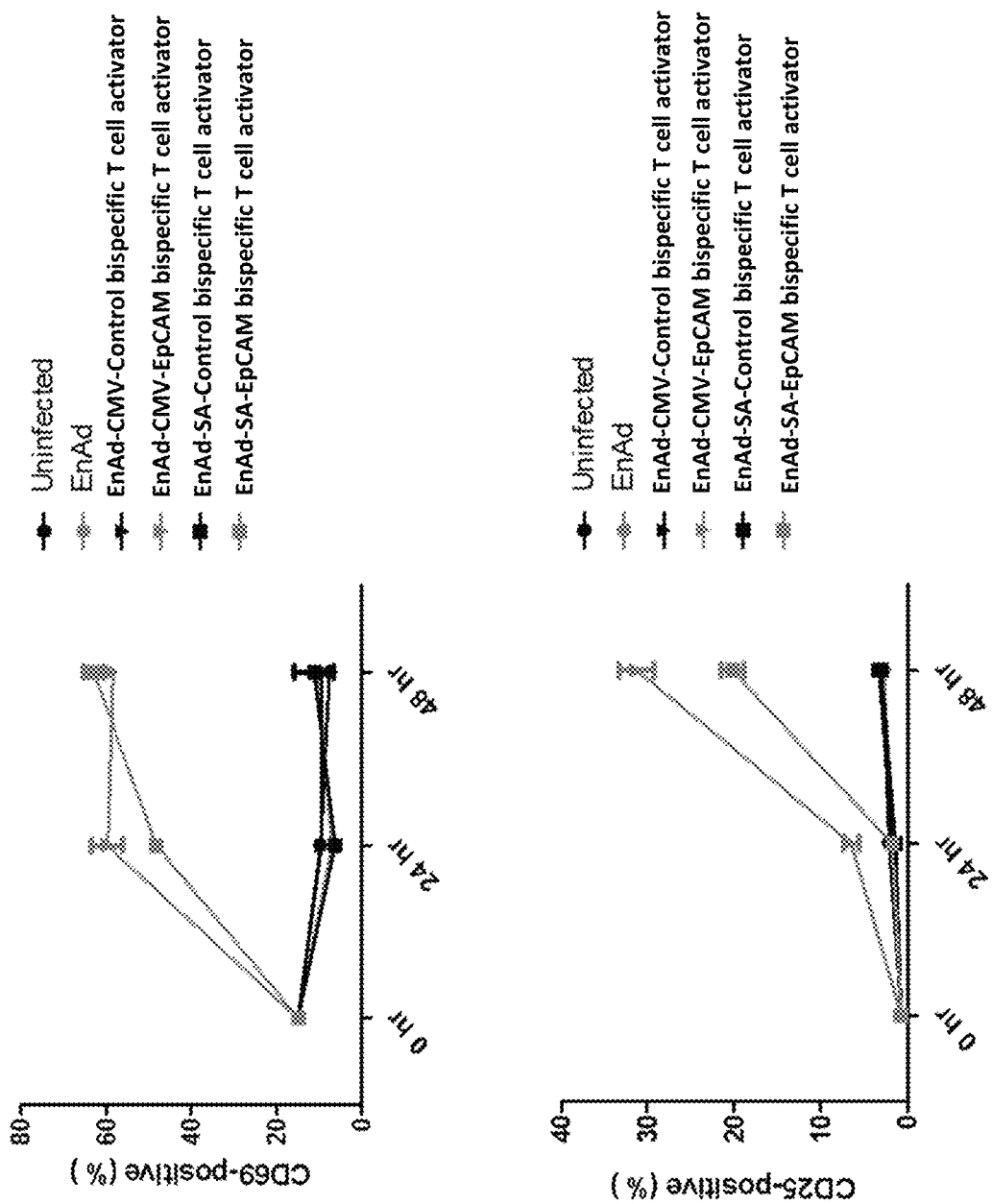
FIG. 32 shows a graph showing T-cell activation (based on CD69 and CD25 expression levels) by EnAd, NG-601, NG-602, NG-603 and NG-604, analysed by flow cytometry.

As an extension of the LDH experiment above, the cells were also harvested at 0, 24, 48 and 96 hours post-treatment, stained with antibodies for CD45, CD69 and CD25 and analysed by flow cytometry to determine activation status of the CD3+ T-cells. The results (FIG. 32) demonstrate that the EpCAM bispecific T-cell activator-expressing viruses NG-601 and NG-602, but not EnAd or control bispecific T-cell activator-expressing viruses NG-603 and NG-604, were able to induce T-cell activation, with kinetics dependent on the promoter used for bispecific T-cell activator expression.

Figure 33:
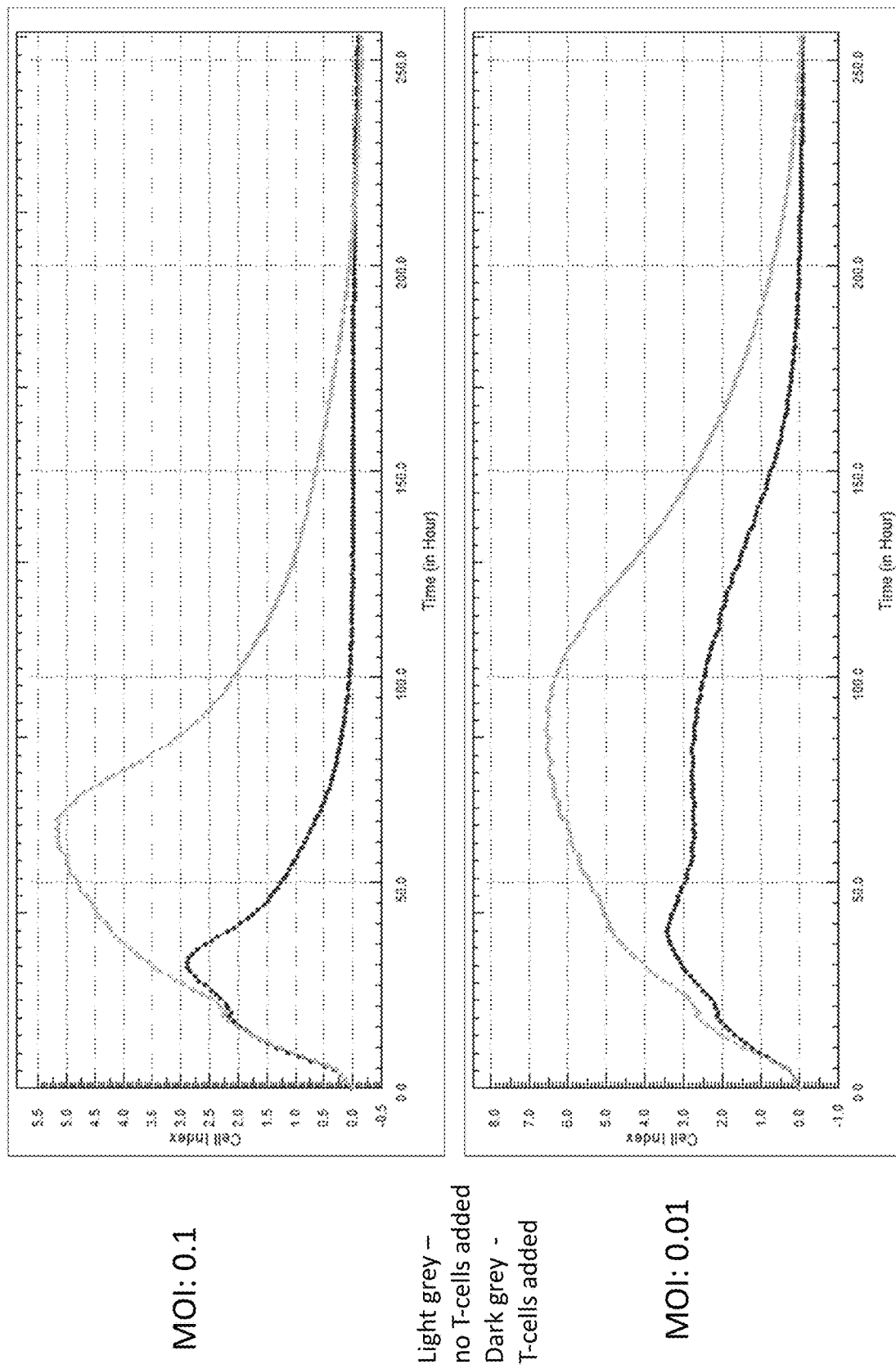
FIG. 33 shows the results of experiments to determine the ability of NG-601 to kill DLD tumour cells at varying multiplicity of infection (MOI) in the presence or absence of CD3$^+$ T-cells, assessed using xCELLigence.
Figure 33:
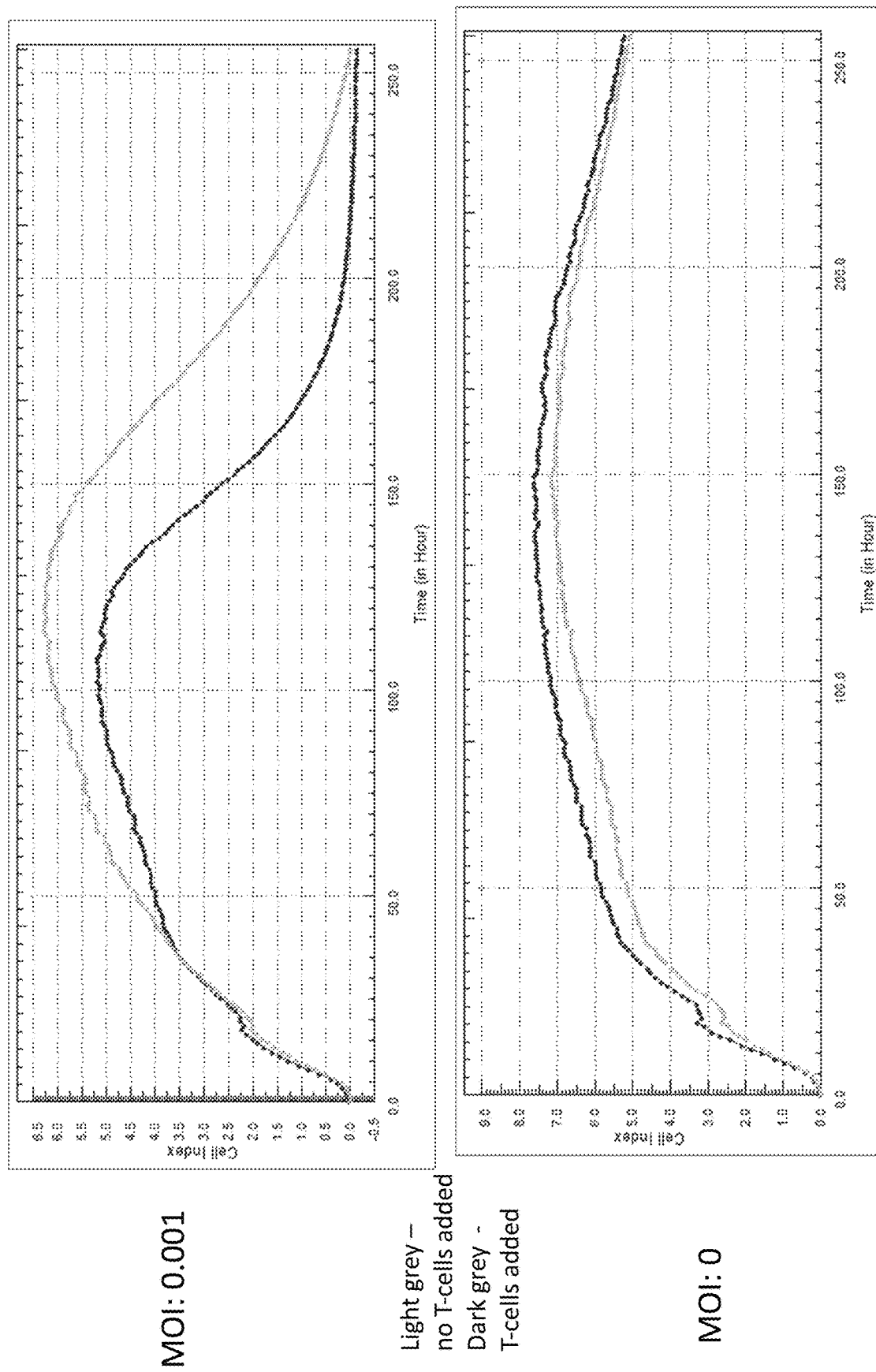

In another experiment, the ability of NG-601 to kill DLD tumour cells at varying multiplicity of infection (MOI) in the presence or absence of CD3+ T-cells was assessed using xCELLigence technology. DLD cells were plated in 48-well E-plate at $2\times10^4$ cells/well. Plates were incubated for 18 hrs, 37° C., 5% $CO_2$, before cells were either infected with NG-601 at MOI (ppc) varying from 0.001 to 10 or left uninfected. Two hours after infection, 150,000 CD3+ T-cells were added to the necessary wells. xCELLigence was used to measure target cell cytotoxicity every 15 minutes. The results (FIG. 33) demonstrate that NG-601 lead to more rapid DLD cytotoxicity in a T cell-dependent manner at MOI's as low as 0.001.

Figure 34:
FIG. 34 shows graphs indicating the ability of EnAd and NG-601, NG-602, NG-603 and NG-604 to kill SKOV tumour cells in the presence or absence of CD3+ T-cells, assessed using xCELLigence.

In a similar experiment, the ability of EnAd and NG-601, NG-602, NG-603 and NG-604 to kill SKOV tumour cells in the presence or absence of CD3+ T-cells was assessed using xCELLigence technology. SKOV cells were plated in 48-well E-plate at $1 \times 10^4$ cells/well. Plates were incubated for 18 hrs, 37° C., 5% $CO_2$, before cells were either infected with EnAd (100 ppc) or were left uninfected. Two hours after infection, 50,000 CD3+ T-cells were added to the necessary wells. xCELLigence was used to measure target cell cytotoxicity every 15 minutes. The results (FIG. 34) suggest that SKOV cells are resistant to EnAd-mediated cytotoxicity over the timeframe of this study, however NG-601 and NG-602 were able to induce rapid lysis of SKOV cells in the presence of CD3+ T-cells.

Figure 35:
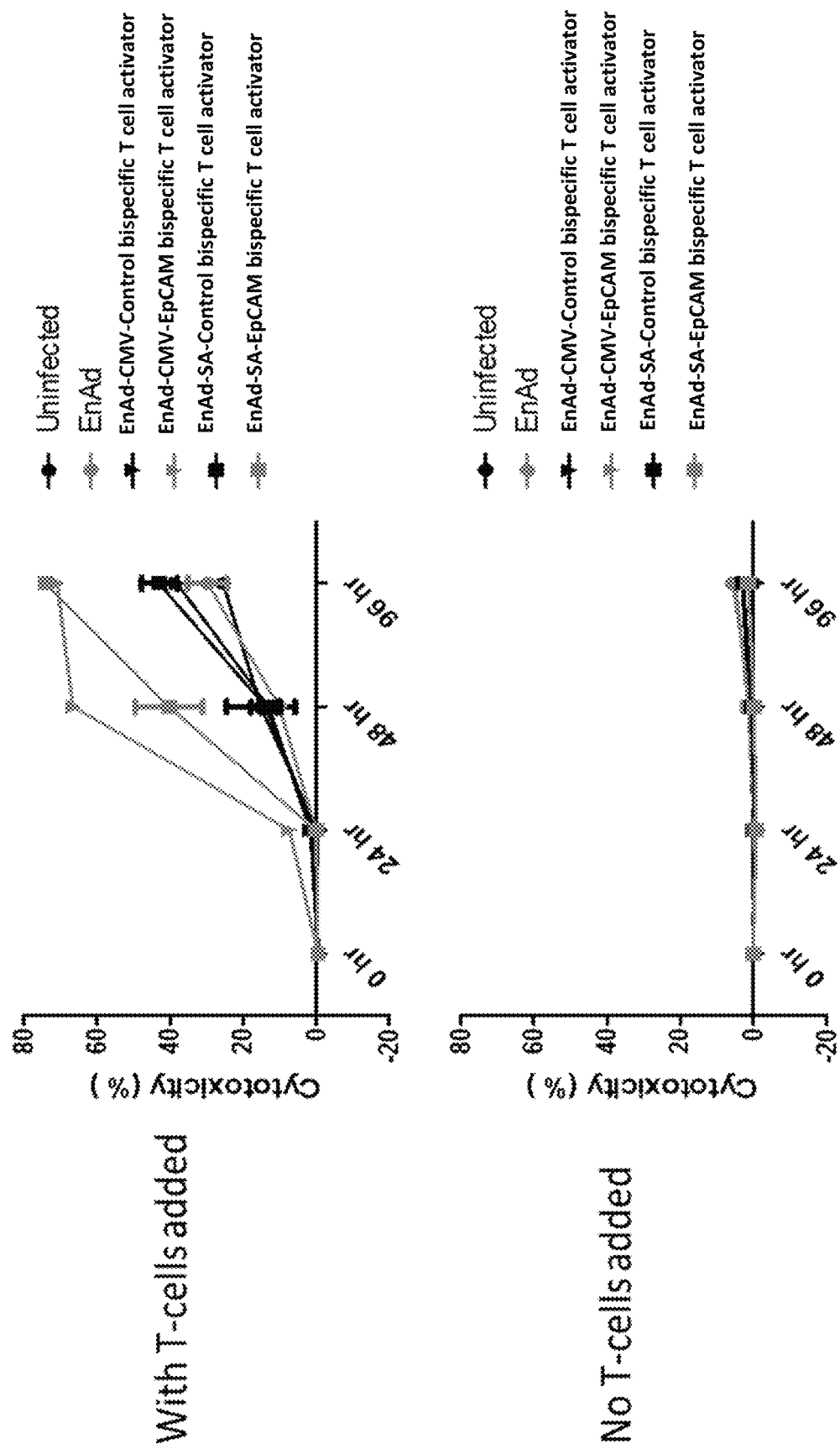
FIG. 35 shows graphs indicating the ability of EnAd and NG-601, NG-602, NG-603 and NG-604 to kill SKOV tumour cells in the presence or absence of CD3+ T-cells, assessed using an LDH assay.

In a similar experiment, the ability of EnAd and NG-601, NG-602, NG-603 and NG-604 to kill SKOV cells in the presence or absence of CD3+ T-cells was assessed using LDH cytotoxicity assay. SKOV cells were plated in 96-well U-bottom plates at $2 \times 10^4$ cells/well and either infected with EnAd (100 ppc) or were left uninfected. Two hours after infection, 150,000 CD3+ T-cells were added to the necessary wells. Plates were incubated at 37° C., 5% $CO_2$ and supernatant harvested and analysed by LDH cytotoxicity assay at 0, 24, 48 and 72 hours post-infection. The results (FIG. 35) are consistent with previous data and suggest that SKOV cells are resistant to EnAd-mediated cytotoxicity over this time frame, however NG-601 and NG-602 are able to induce rapid lysis of SKOV cells in the presence of CD3+ T-cells.

Figure 36:
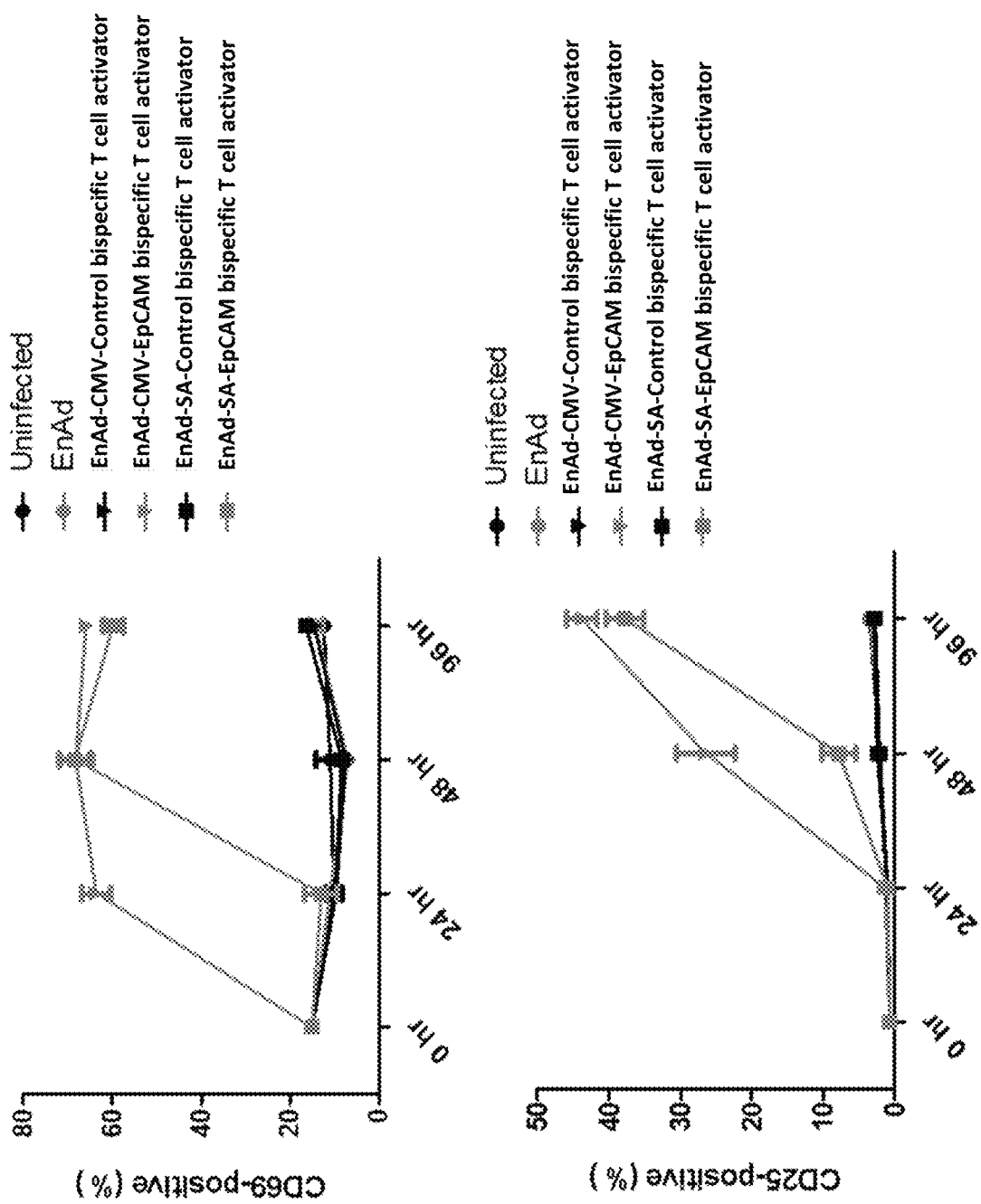
FIG. 36 shows a graph showing T-cell activation (based on CD69 and CD25 expression levels) by EnAd, NG-601, NG-602, NG-603 and NG-604 co-cultured with SKOV tumour cells, analysed using flow cytometry.

As an extension of the LDH experiment above, the cells were also harvested at 0, 24, 48 and 96 hours post-treatment, stained with antibodies for CD 45, CD 69 and CD25 and analysed by flow cytometry to determine activation status of CD3+ T-cells (FIG. 36). The results demonstrate that the EpCAM bispecific T-cell activator-expressing viruses NG-601 and NG-602, but not EnAd or control bispecific T-cell activator-expressing viruses NG-603 and NG-604, were able to induce T-cell activation, with kinetics dependent on the promoter used for bispecific T-cell activator expression.

Figure 37:
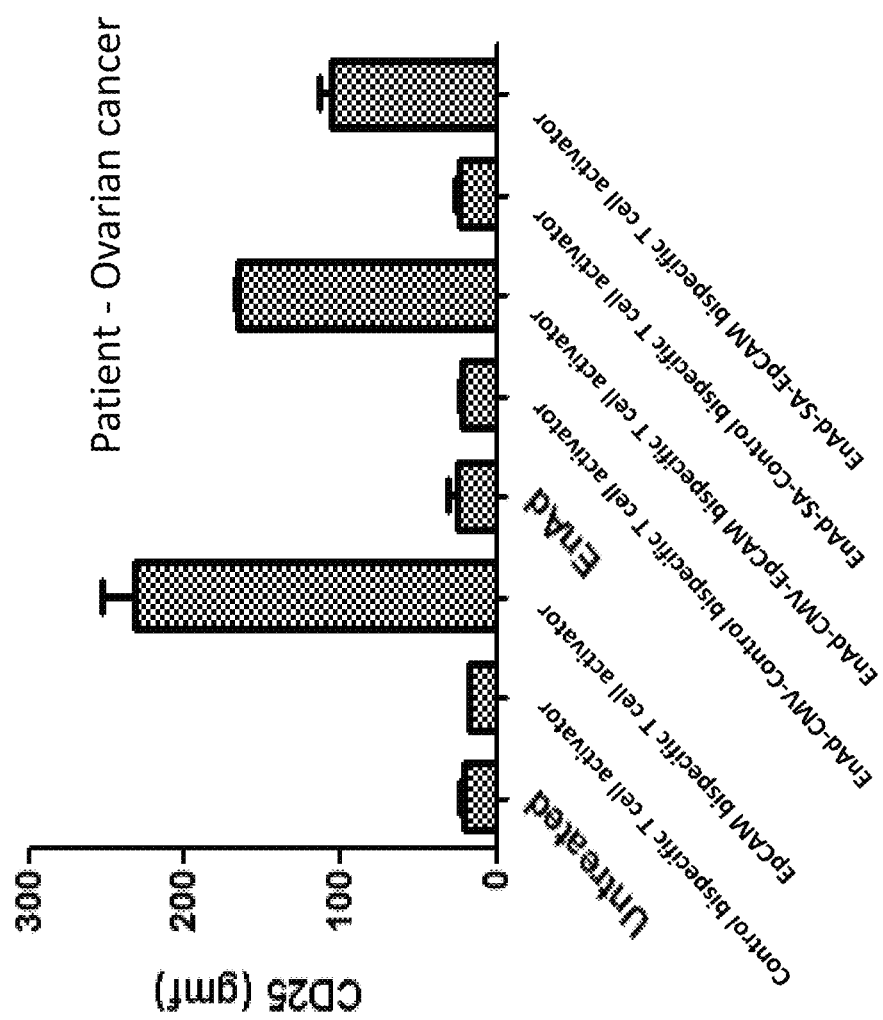
FIG. 37 shows a graph showing T-cell activation (based on CD69 and CD25 expression levels) by EnAd, NG-601, NG-602, NG-603 and NG-604 co-cultured with ascites cells, analysed using flow cytometry.

In a similar experiment, the ability of EnAd and NG-601, NG-602, NG-603 and NG-604 to activate cancer patient-derived CD3+ T-cells from a CD3$^+$ EpCAM-negative primary ascites sample was assessed. EpCAM-positive DLD cells were plated at $1 \times 10^4$ cells per well in a 96-well U-bottom plate and co-cultured with 100,000 ascites cells (unchanged from when received). Cells were infected with viral particles at 100 ppc or were left uninfected. After incubation at 37° C. for 48 hours, the total cell population was harvested and the expression level of CD25 on CD3+ T-cells determined by flow cytometry. The results (FIG. 37) demonstrate that the EpCAM bispecific T-cell activator-expressing viruses NG-601 and NG-602, but not EnAd or control bispecific T-cell activator-expressing viruses NG-603 and NG-604, were able to induce T-cell activation of patient-derived CD3$^+$ T-cells.

The results indicate that both EpCAM bispecific T-cell activators viruses NG-601 and NG-602 were able to induce T cell activation and target cell lysis, although the kinetic profile was slightly different depending on the promoter used.

Figure 38:
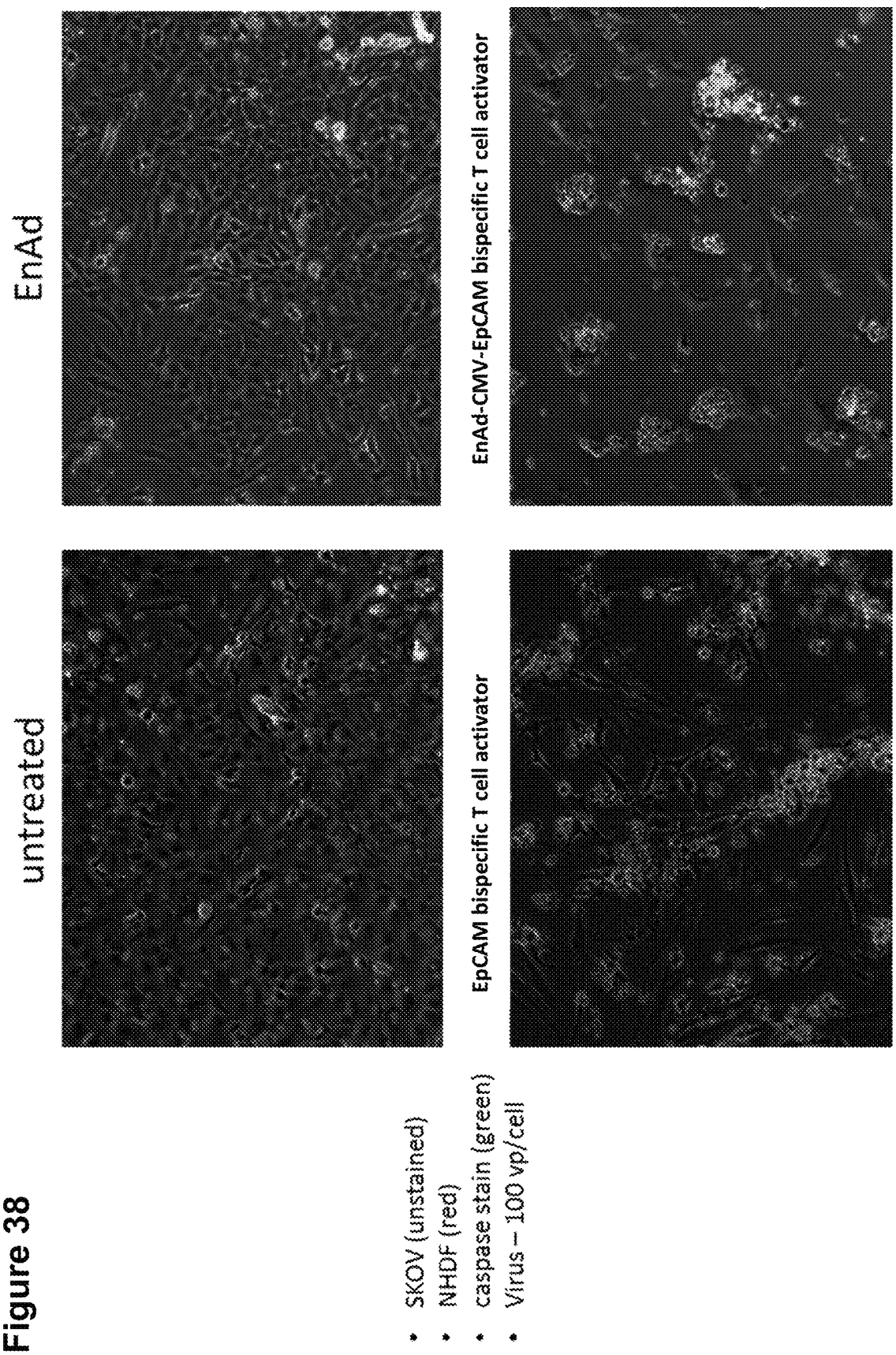
FIG. 38 shows still frame images from timelapse videos of lysis of NHDF cells by EpCAM bispecific T-cell activators, EnAd, NG-601 or NG-603.

Timelapse videos were obtained to observe viral or T cell-mediated lysis of target cells by recombinant EpCAM bispecific T-cell activator, EnAd, NG-601 or NG-603. NHDF cells were stained with CellTracker Orange CMTMR Dye (Life Tech, #C2927) and CD3+ T-cells were stained with CellTrace Violet Cell Proliferation Kit (Life Tech, #C34557) following manufacturer's protocols. Dyed NHDF were plated in a 24-well plate at $7.5 \times 10^3$ cells/well in co-culture with $1.35 \times 10^4$ DLD or SKOV tumour cells. Plates were incubated for 18 hrs, 37° C., 5% $CO_2$. Cells were then treated with 300 ng/mL EpCAM bispecific T-cell activator or infected with EnAd, NG-601 or NG-603 at 100 ppc or left untreated. After two hours incubation, 100,000 dyed CD3+ T-cells were added to necessary wells, in addition to 1.5 µM CellEvent Caspase 3-7 reagent (Life Tech, #C10423). Videos were obtained on Nikon TE 2000-E Eclipse inverted, with images captured every 15 minutes for 96 hours. Frames from the videos are shown in FIG. 38. The results show that the recombinant Ep CAM bispecific T-cell activator and NG-605 lead to rapid lysis of both DLD and SKOV target cells, but NHDF remained unaffected.

Example 16

In this example, the activation of autologous tumour-associated lymphocytes from FAP primary malignant ascites from cancer patients by EnAd, NG-603, NG-604, NG-605 and NG-606 was evaluated. Patient samples considered suitable for further analysis were those containing CD3+ T-cells and FAP$^+$ cells.

Figure 40:
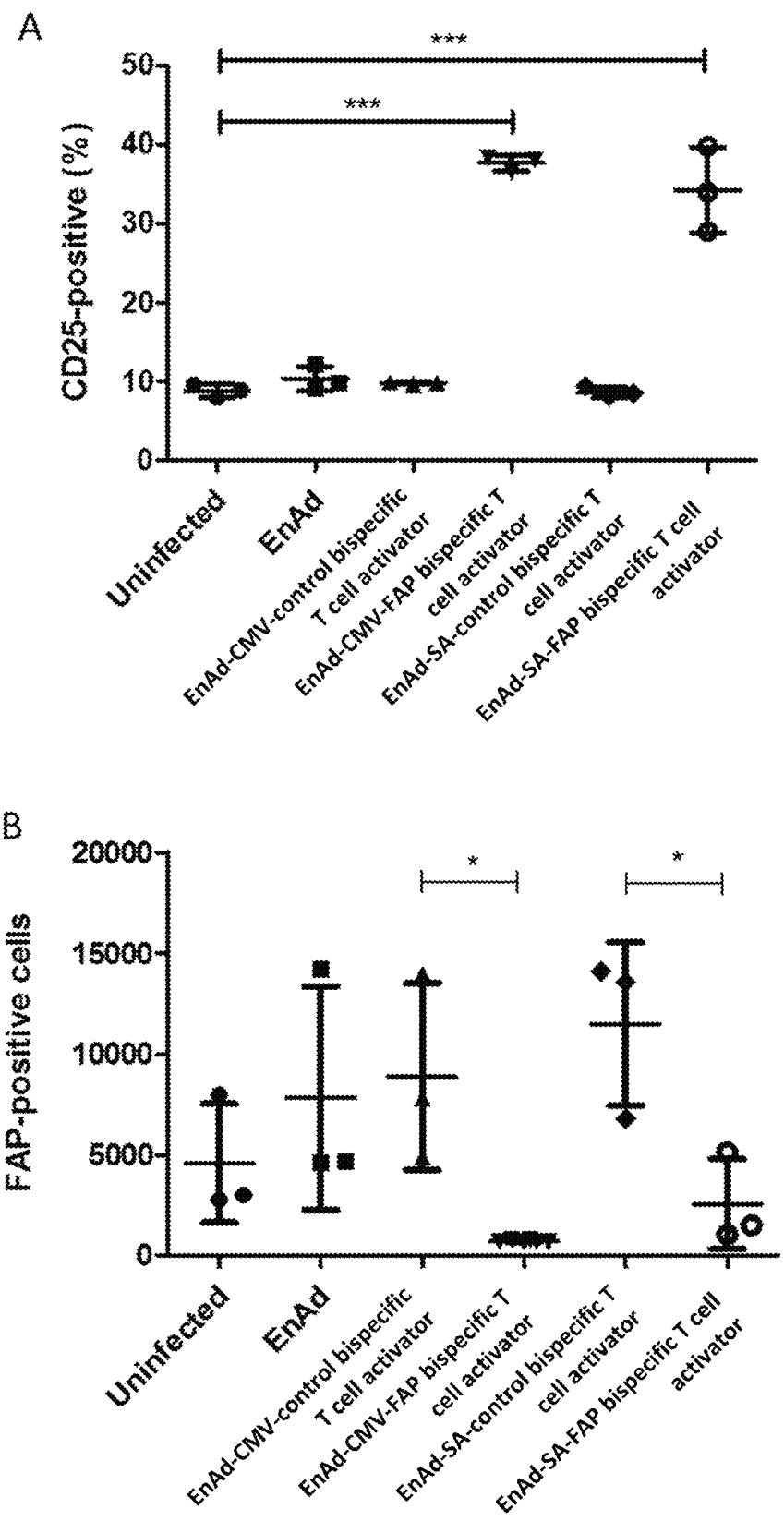
FIG. 40 (A) graph indicating the expression levels of CD25 on CD3+ T cells in ascites samples which were infected with viruses of the present disclosure. (B) graph indicating the number of FAP+ cells in ascites samples which were infected with viruses of the present disclosure.

In the first experiment, unpurified (therefore unchanged from when received) ascites cells from a patient were seeded at 250,000 cells per well of a U-bottom 96-well plate in 100% ascites fluid. Cells were infected with viruses at 100 ppc, with untreated wells serving as negative controls. EnAd-CMV-GFP and EnAd-SA-GFP were also included in the experiment as a reporter to determine infection and late stage viral gene expression, respectively, with micrographs shown in FIG. 39. After incubation at 370 C for 5 days, the total cell population was harvested and the expression level of CD25 on CD3+ T-cells (FIG. 40, panel A) was determined. Total cell numbers per well were determined using precision counting beads. The results demonstrate that the FAP bispecific T-cell activator viruses NG-605 and NG-606 resulted in significant increases in T-cell activation of tumour-associated lymphocytes.

As an extension of the experiment above, replicate wells were harvested and the number of endogenous FAP$^+$ cells determined by flow cytometry. Total cell numbers per well were determined using precision counting beads. The results (FIG. 40, panel B) show that NG-605 and NG-606 resulted in a significant decrease in numbers of autologous FAP-expressing cells in the ascites samples, suggesting some FAP$^+$ cells had been killed by the activated T-cells.

Figure 42:
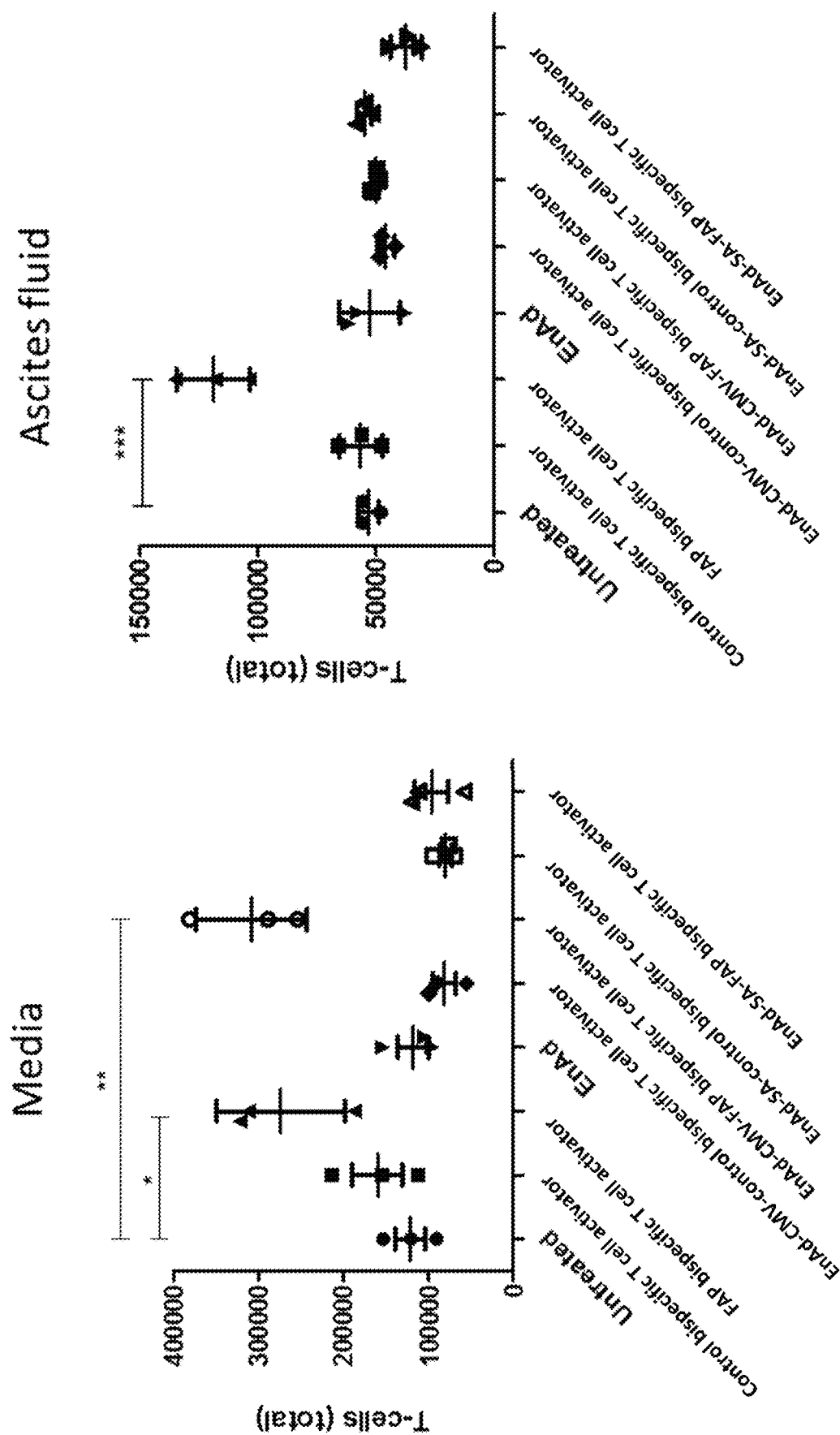
FIG. 42 shows a graph indicating the number of CD3+ T cells in ascites samples obtained from a cancer patient and infected with viruses of the present disclosure.
Figure 43:
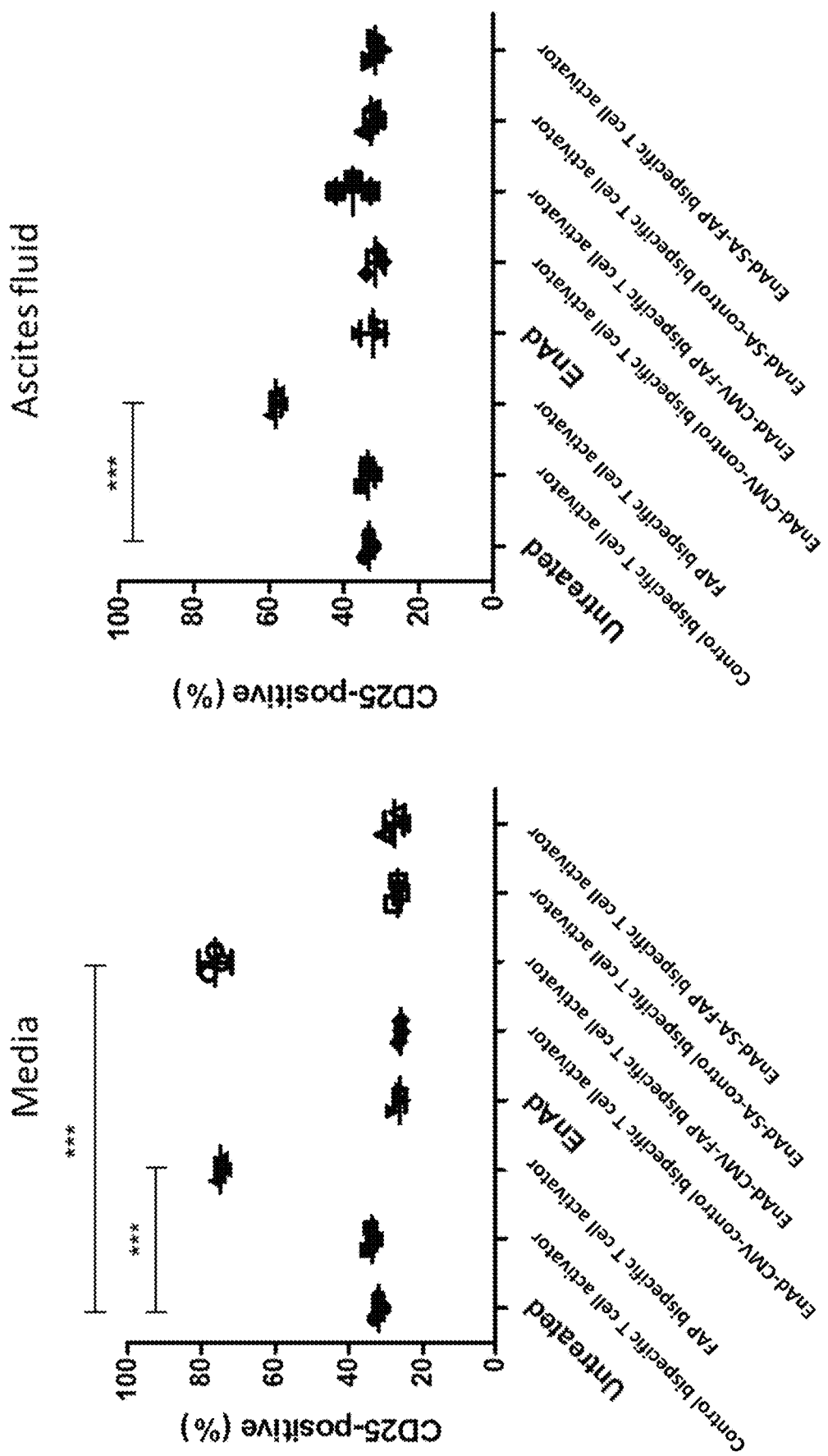
FIG. 43 shows a graph indicating the CD25 expression levels on CD3+ T cells in ascites samples obtained from a cancer patient and infected with viruses of the present disclosure.

In a second experiment, unpurified (therefore unchanged from when received) ascites cells from a cancer patient were seeded at 250,000 cells per well of a U-bottom 96-well plate in either 100% ascites fluid or medium supplemented with 1% human serum. Cells were infected with viruses at 100 ppc, with untreated wells serving as negative controls. EnAd-CMV-GFP and EnAd-SA-GFP were also included as a reporter to determine infection and late stage viral gene expression, respectively, with micrographs shown in FIG. 41. After incubation at 37° C. for 5 days, the total cell population was harvested and the number of CD3+ T-cells (FIG. 42) and expression level of CD25 on CD3+ T-cells (FIG. 43) was determined. Total cell numbers per well were determined using precision counting beads. The results demonstrate that for this patient recombinant FAP bispecific T-cell activator and NG-605, but not NG-606, resulted in significant increase in T-cell activation of tumour-associated lymphocytes in media. Neither virus led to activation in ascites fluid.

Figure 44:
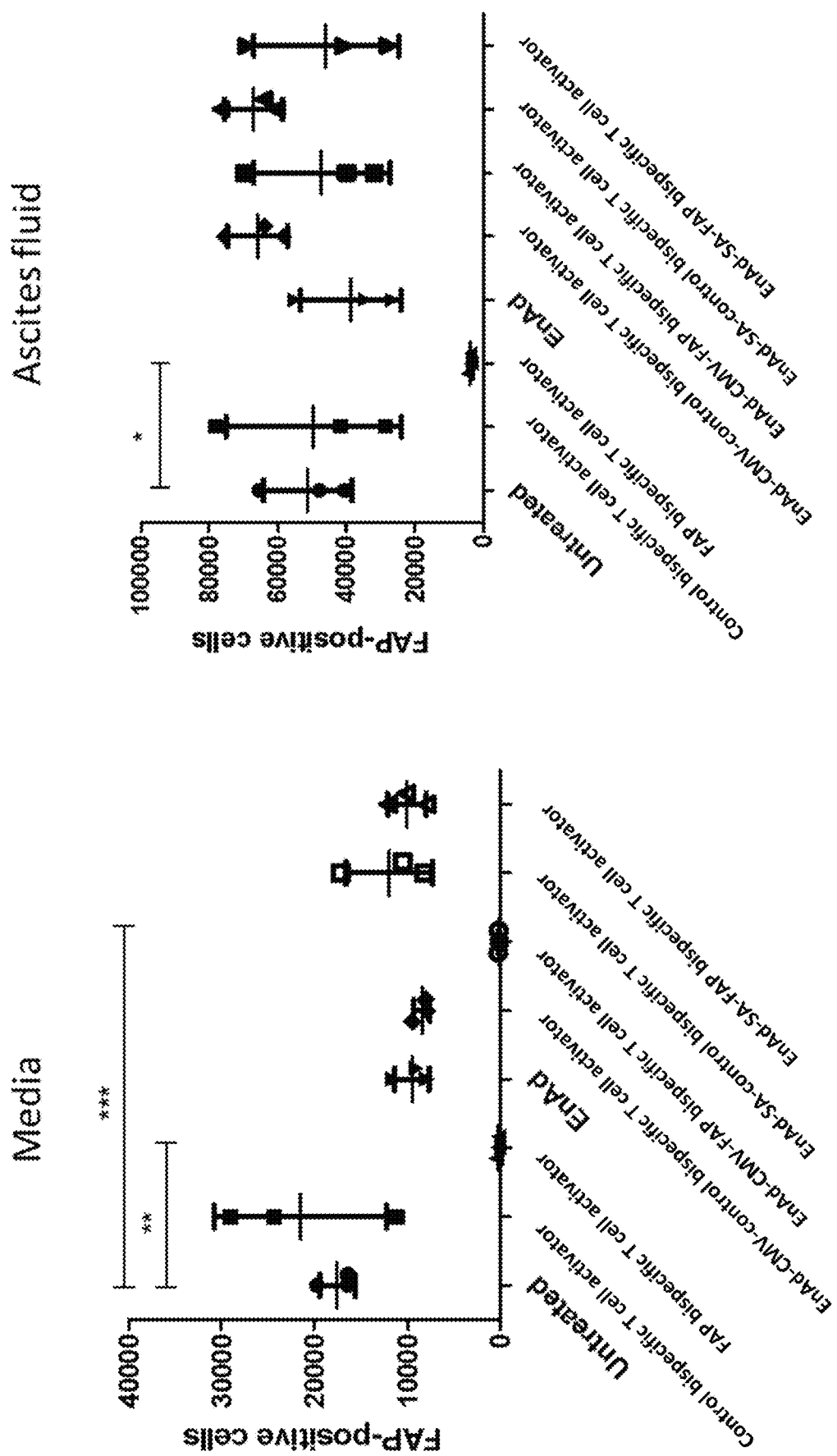
FIG. 44 shows a graph indicating the number of FAP+ cells in ascites samples obtained from a cancer patient and infected with viruses of the present disclosure.

As an extension of the experiment above, replicate wells were harvested and the number of FAP+ cells was determined by flow cytometry (FIG. 44). Total cell numbers per well were determined using precision counting beads. The results demonstrate that recombinant FAP bispecific T-cell activator and NG-605, but not NG-606, resulted in a significant decrease in numbers of autologous FAP-expressing cells in media. Neither virus led to a reduction in FAP+ cells in ascites fluid.

Example 17—Materials and Methods

Cell Lines

HEK293A, DLD, SKOV3, MCF7, A431, A549 and PC3 cells (ATCC) were cultured in Dulbecco's Modified Eagle's Medium (DMEM, Sigma-Aldrich, UK) and CHO cells (ATCC) in Roswell Park Memorial Institute (RPMI-1640, Sigma-Aldrich, UK). Growth media was supplemented with 10% (v/v) fetal bovine serum (FBS, Gibco, UK) and 1% (v/v) penicillin/streptomycin (10 mg/mL, Sigma-Aldrich) and cells maintained in humidified atmosphere at 37° C. and 5% CO2. For virus infections and virus plasmid transfections cells were maintained in DMEM supplemented with 2% FBS. For recombinant bispecific T-cell activator plasmid transfections cells were maintained in DMEM without FBS. EpCAM expression of target cell lines was determined by flow cytometry.

Generation of EpCAM-Expressing Stable Cell Lines

The protein sequence of the EpCAM gene (ID: 4072) was obtained from NCB I database and DNA synthesised by Oxford Genetics Ltd (Oxford, UK). The EpCAM gene was cloned into pSF-Lenti vector by standard cloning techniques producing the pSF-Lenti-EpCAM vector. HEK293T cells were transfected using Lipofectamine 2000 with lentivirus EpCAM expression vector alongside pSF-CMVHIV-Gag-Pol, pSF-CMV-VSV-G, pSF-CMV-HIV-Rev (Oxford Genetics Ltd). Supernatants containing lentivirus were harvested 48 h later and mixed with polybrene (8 1.1 g/mL). Lentivirus/polybrene mixtures were added to CHO cells and incubated at 37° C. On day 4, the supernatant was exchanged for media containing 7.5 µg/mL puromycin. Stable variants were then clonally selected and EpCAM expression of the parental cell lines or stable-transfected variant was determined by antibody staining with EpCAM or isotype control antibody and analysed by flow cytometry. Positive clones were expanded and used in further experiments.

Preparation of Peripheral Blood Mononuclear Cells (PBMC) and T Cell Isolation

PBMCs were isolated by density gradient centrifugation (Boyum, 1968) from whole blood leukocyte cones obtained from the NHS Blood and Transplant UK (Oxford, UK). Blood was diluted 1:2 with PBS and layered onto Ficoll (1,079 g/mL, Ficoll-Paque Plus, GE Healthcare) before centrifugation at 400 g for 30 min at 22° C. with low deceleration. After centrifugation, PBMCs were collected and washed twice with PBS (300 g for 10 min at room temperature) and resuspended in RPMI-1640 medium supplemented with 10% FBS. For extraction of CD3-positive T-cells from PBMCs, non-CD3 cells were depleted using Pan T Cell Isolation Kit (Miltenyi Biotec, #130-096-535), according to the manufacturer's protocol. For further isolation of CD4- and CD8-positive T-cells, CD3 T-cells underwent another round of purification using CD4+ Microbeads (Miltenyi Biotec, #130-045-101).

Processing Primary Ascites and Pleural Effusions

Primary human malignant ascites and pleural effusion samples were received from the Churchill Hospital, Oxford University Hospitals (Oxford, UK) following informed consent from patients with multiple indications of advanced carcinoma, including but not limited to ovarian, pancreatic, breast and lung. This work was approved by the research ethics committee of the Oxford Centre for Histopathology Research. Upon receipt, cellular and fluid fractions were separated and fluid used immediately or aliquots stored at −20° C. for future analysis. The cellular fraction was treated with red blood cell lysis buffer (Roche, UK) following manufacturer's instructions. Cell number and viability was determined by trypan blue stain. Cell types present in each sample were determined by antibody staining for EpCAM, EGFR, FAP, CD45, CD11b, CD56, CD3, CD4, CD8, PD1 and CTLA4 and analysed by flow cytometry. For ex vivo T-cell activation and target cell lysis experiments fresh cells and fluid were used. In some cases, the adherent cells were passaged in DMEM supplemented with 10% FBS and expanded for later use.

Bispecific T-Cell Activator Engineering and Production

Bispecific T-cell activators were generated by joining two scFvs of different specificities with a flexible GS linker. Each scFv is created by the joining of VH and VL domains from parental monoclonal antibodies by a linker. Each Bbispecific T-cell activator possessed an immunoglobulin light chain (Ig) N-terminal signal sequence for mammalian secretion and a C-terminal decahistidine affinity tag for detection and purification. Bispecific T-cell activators were engineered by standard DNA cloning techniques and inserted into a protein expression vector (pSFCMV-Amp) for cytomegalovirus (CMV) promoter-driven constitutive protein expression and secretion. pSF-CMV-EpCAMbispecific T-cell activator or pSF-CMV-Controlbispecific T-cell activator plasmid DNA were transfected into HEK293A cells using polyethylenimine (PEI, linear, MW 25000, Polysciences, USA) under the following conditions, 55 µg of plasmid DNA:110 µg PEI (DNA:PEI ratio of 1:2 (w/w)) was added to cells, incubated at 37° C. for 4 h, then replaced with fresh serum-free DMEM and further incubated at 37° C., 5% CO2 for 48 h. Cells were transfected in parallel with pSF-CMV-GFP to ensure transfection efficiency. To harvest secreted protein, the supernatant of transfected cells was collected and centrifuged at 350 g, 4° C. for 5 min to remove cell components. Supernatants were transferred to 10,000 MWCO Amicon Ultra-15 Centrifugal Filter Units (Millipore). After centrifugation at 4750 g and 4° C., the volume of the retentate was adjusted with the flow through to obtain a 50-fold higher concentration. Aliquots of concentrated protein were stored at −80° C.

Generation of Bispecific T-Cell Activator-Expressing EnAdenotucirev

The plasmids pEnAd2.4-CMV-EpCAMbispecific T-cell activator, pEnAd2.4-SA-EpCAMbispecific T-cell activator, pEnAd2.4-CMV-Controlbispecific T-cell activator, pEnAd2.4-SA-Controlbispecific T-cell activator were generated by direct insertion of the transgene cassette encoding the EpCAM bispecific T-cell activator or control bispecific T-cell activator into the basic EnAd plasmid pEnAd2.4 using Gibson assembly technology. The transgene cassette contained a 5' short splice acceptor sequence or an exogenous CMV promoter, followed downstream by the EpCAM or control bispecific T-cell activator cDNA sequence and a 3' polyadenylation sequence. A schematic of the inserted transgene cassette is shown in FIG. 18. Correct construction of the plasmid was confirmed by DNA sequencing. The plasmids EnAd2.4-CMV-EpCAMbispecific T-cell activator, pEnAd2.4-SA-EpCAMbispecific T-cell activator, pEnAd2.4-CMV-Controlbispecific T-cell activator and pEnAd2.4-SA-Controlbispecific T-cell activator were linearised by restriction digest with the enzyme AscI prior to transfection in HEK293A cells. The production of virus was monitored by observation of cytopathic effect (CPE) in the cell monolayer. Once extensive CPE was observed the virus was harvested from HEK293A cells by three freeze-thaw cycles. Single virus clones were selected by serially diluting harvested lysate and re-infecting HEK293A cells, and harvesting wells containing single plaques. Serial infections of HEK293A cells were performed once an infection had reached full CPE in order to amplify the virus stocks. Once potent virus stocks were amplified the viruses were purified by double caesium chloride banding to produce EnAd-CMVEpCAMbispecific T-cell activator, EnAd-SA-EpCAMbispecific T-cell activator, EnAd-CMV-Controlbispecific T-cell activator, EnAd-SA-Controlbispecific T-cell activator virus stocks. These stocks were titred by TCID50 and picogreen assay (Life Technologies), following manufacturer's instructions.

Preparation of Supernatants

To evaluate bispecific T-cell activator-mediated cytokine release, DLD cells (20,000) were plated with 100,000 CD3+ T-cells in 96-well flat bottom plate alone or with 2 ng/μL EpCAM or control bispecific T-cell activators. After 48 h incubation at 37° C. and 5% CO2, supernatants were collected, cell components removed by centrifugation and aliquots stored at −20° C. To assess bispecific T-cell activator transgene expression from recombinant viruses, HEK293A (1e6) or DLD cells (1.2e6) were infected with EnAd-CMV-EpCAMbispecific T-cell activator, EnAd-SA-EpCAMbispecific T-cell activator, EnAd-CMVControlbispecific T-cell activator, EnAd-SA-Controlbispecific T-cell activator or EnAd at 100 vp/cell. Cells were cultured for 72 h at which point the cytopathic effect (CPE) was advanced. Supernatants were collected and centrifuged for 5 min, 300 g to remove cell debris and stored at −20° C. for future analysis.

Immunoblotting

Dot blot was used to measure the concentration of recombinant bispecific T-cell activator produced from plasmid transfections. Two-fold serial dilutions of each bispecific T-cell activator and of a protein standard (10×His-tagged (Cterminus) human Cathepsin D, Biolegend, #556704) were prepared. The molar concentration of the protein standard was adjusted to represent a bispecific T-cell activator concentration of 100 μg/mL. Two μL of each sample and protein standard was directly applied onto a nitrocellulose membrane. The membrane was airdried, blocked and probed with α-6×His (C-terminus) antibody (1:5000, clone 3D5, Invitrogen, UK, #46-0693) for detection of C-terminally His-tagged proteins, followed by washing and incubation with antimouse secondary antibody (1:10000, Dako, #P0161) and detected by application of SuperSignal West Dura Extended Duration Substrate (Thermo Fisher, #34075) according to manufacturer's instructions. Supernatants of virus-infected HEK293A cells were analysed by Western blotting for bispecific T-cell activator expression. Supernatants were fractionated by SDS-PAGE and transferred to a nitrocellulose membrane according to manufacturer's protocols (Bio-Rad). Membranes were further treated identically to that of dot blot protocol above.

Enzyme-Linked Immuno-Sorbent Assay (ELISA)

To assess EpCAM binding, ELISA plates were prepared by coating overnight at 4° C. with human EpCAM/TROP-1 protein (50 ng/well, Sino Biological Inc, #10694-H02H-50). Plates were blocked for 1 h at ambient temperature with 5% BSA, followed by incubation with diluted EpCAM bispecific T-cell activator-, Control bispecific T-cell activator- and empty pSF-CMV vector-transfected HEK293A supernatants (2 h, room temperature). Plates were washed three times with PBS-T and subsequently after every future binding step. Plates were incubated with anti-His (C-term) antibody (1:5000, clone 3D5, #46-0693, Invitrogen, UK) for 1 h, room temperature, followed by HRP conjugated anti-mouse-Fc (1:1000 in PBS/5% milk, Dako) for 1 h at room temperature. HRP detection was performed using 3.3.5.5'-teramethylethylenediamine (TMB, Thermo-Fisher) and stop solution was used for terminating the reaction. Absorbance at 450 nm was measured on a Wallac 1420 plate reader (Perkin Elmer).

Flow Cytometry

Flow cytometry analysis was performed on a FACSCalibur flow cytometer (BD Biosciences) and data processed with FlowJo v10.0.7r2 software (TreeStar Inc., USA). For classification of different cellular populations, antibodies specific for CD45 (HI30, Biolegend), CD11b (ICRF44, Biolegend), EpCAM (9C4, Biolegend) and FAP (427819, R&D Systems) were used. For analysis of T-cell populations, the following antibody clones coupled to different fluorophores were used: CD69 (FN50, Biolegend), CD25 (BC96, Biolegend), IFNγ (4S.B3, Biolegend), aCD107a antibody (H4A3, Biolegend), CD3 (HIT3a, Biolegend), CD4 (OKT4, Biolegend), CD8a (HIT8a, Biolegend), PD1 (H4A3, Biolegend). In each case, the appropriate isotype control antibody was used.

Characterisation of Human T-Cell Activation

CD69 and CD25 Expression Levels

The ability of the recombinant EpCAM bispecific T-cell activator or EpCAM bispecific T-cell activator viruses to induce T-cell activation was assessed by surface expression of CD69 and CD25. Human CD3 cells (75,000 cells/well in 96-well flatbottom plates) from PBMC or ascites samples were cultured alone or with DLD, SKOV, CHO, CHOEpCAM or ascites target cells (15,000) in the presence of media alone, EpCAM or control bispecific T-cell activator protein (2 ng/μL) or recombinant virus (100 vp/cell). In some cases, anti-PD1 (Invivogen, #hpd1ni-mab7) antibody was added at a final concentration of 2.5 μg/mL. CD3 cells were incubated with CD3/CD28 Dynabeads (Thermo Fisher, #11131D) as positive control for T cell activation. Cells were cultured medium for 24 h at 37° C. unless stated otherwise and subsequently harvested with enzyme free cell dissociation buffer (Gibco, #13151014). Total cells were stained with antibodies for surface expression of CD69, CD25, CD3, CD4 or CD8 and analysed by flow cytometry. The effect of ascites fluid on T-cell activation (CD69, CD25) was investigated by polyclonally activating CD3-purified PBMC (100,000) by incubating with plate-immobilised CD3 antibody (7.5 μg/mL, HIT3a, Biolegend, #300313) in RPMI-1640 or fluids isolated from the malignant ascites samples.

IFNγ Expression

The ability of the EpCAM bispecific T-cell activator to induce T-cell activity was assessed by IFNγ expression, by co-culture of T-cells for 6 h with DLD cells (200,000 CD3 cells/well, 40,000 DLD cells/well in a flat-bottom 96 well plate) and 2 ng/μL recombinant EpCAM or control bispecific T-cell activator. As a positive control, T cells were stimulated with soluble PMA/ionomycin cell activation cocktail (Biolegend, #423301). Brefeldin A (GolgiPlug, BD Biosciences) was added into the culture medium 5 h before harvest, at which point CD3+ T-cells were harvested and intracellularly stained for IFNγ expression and analysed by flow cytometry.

T Cell Proliferation

To study T cell proliferation, 100,000 CFSE-labelled (CellTrace CFSE kit, Invitrogen, #C34554) CD3+ T cells were incubated with 20,000 DLD cells in 96 well plate format, with 2 ng/μL EpCAM or control bispecific T-cell activator. Five days after co-culture, cells were stained for CD3, CD4 or CD8 and CFSE fluorescence of viable CD3+ T-cells were measured by flow cytometry, with total cell number normalised using precision counting beads (5000/well, Biolegend, #424902). Fluorescence data was analysed and modelled using the proliferation function of FlowJo v7.6.5 software. Data is presented as the percentage of original cells that entered a proliferation cycle (% divided) or the average number of cell divisions that a cell in the original population has undergone (Division Index).

CD107a Degranulation

DLD cells (15,000 cells/well) were co-cultured with 75,000 CD3+ T-cells in a flat-bottom 96 well plate in the presence of media alone or 2 ng/μL of control or EpCAM bispecific T-cell activator. aCD107a or isotype control antibodies were added directly to the culture medium. Monensin (GolgiStop, BD Biosciences) was added after 1 h of incubation at 37° C. and 5% CO2, followed by 5 h of further incubation. Cells were subsequently harvested, stained for CD3, CD4 or CD8 and analysed by flow cytometry.

Cytokine Release

Cytokines within supernatants harvested from cultures of DLD/PBMC or pleural effusion cells were quantified using the LEGENDplex Human T Helper Cytokine panel (Biolegend, #740001) and flow cytometry following the manufacturer's instructions. Cytokines included in the analysis are IL-2, IL-4, IL-5, IL-6, IL-9, IL-10, IL-13, IL-17A, IL-17F, IL-21, IL-22, IFNγ and TNFα.

In Vitro Target Cell Cytotoxicity Assay

Target cell cytotoxicity mediated by recombinant bispecific T-cell activator or viruses was assessed by LDH release or MTS assay. Target cells (DLD, SKOV, HT-29, A431, A549, PC3, CHO, CHO-EpCAM) were co-cultured with CD3, CD4 or CD8 T-cells (E:T 5:1) in a flat-bottom 96 well plate in the presence of media alone, diluted supernatants or virus (100 vp/cell). After 24 h of co-culture (unless stated otherwise), supernatants and cells were harvested and cytotoxicity determined by LDH assay (CytoTox 96 Non-Radioactive Cytotoxicity Assay, Promega, #G1780) or MTS viability assay (CellTiter 96 Cell Proliferation Assay, Promega, #G3580) as per manufacturer's instructions. Quantity of bispecific T-cell activator produced from virus-infected DLD cells was determined by comparing cytotoxicity induced by diluted viral supernatants to that of a standard curve generated using recombinant bispecific T-cell activator.

To evaluate oncolytic activity of the viruses, DLD cells were seeded in 96-well plate (25,000 cells/well) for 18 h at 37° C. and 5% CO2, before infection with increasing vp/cell (5-fold serial dilution, 100 to 5.12e-5 vp/cell) or left uninfected. DLD cytotoxicity was measured on day 5 by MTS viability assay. Dose response curves were fitted and IC50 determined using a four parameter non-linear fit model integrated into Prism 7 software (GraphPad Software). Cell viability was monitored in real-time using xCELLigence RTCA DP technology (Acea Biosciences). DLD, SKOV3 or MCF7 cells were plated in 48-well E-plate at 12,000 cells/well. Plates were incubated for 18 h, 37° C., 5% CO2, before cells were either treated with bispecific T-cell activator (2 ng/μL) or infected with virus (100 vp/cell) or left untreated. Two hours after infection, 75,000 CD3+ cells were added to the necessary wells. Cell impedance was measured every 15 min for a duration of up to 160 h. For ex vivo cytotoxicity assays, unpurified cells from ascites or pleural effusion samples were resuspended in ascites fluid and plated (1.5e5/well) in flat bottom 96-well plates. After incubation for the stated duration at 37° C., 5% CO2, supernatants were analysed by LDH assay or total cells were harvested by cell-dissociation buffer, stained for CD3, CD25 and EpCAM, and analysed by flow cytometry. For PD1 blocking experiments, anti-PD1 antibody (2.5 μg/mL, Invivogen, #hpd1ni-mab7) antibody was included.

Viral Genome Replication and qPCR

The ability of EnAd-CMV-EpCAMbispecific T-cell activator, EnAd-SA-EpCAMbispecific T-cell activator, EnAd-CMV-Controlbispecific T-cell activator, EnAd-SAControlbispecific T-cell activator or EnAd to replicate their genomes was analysed by seeding DLD cells in 24-well plate (150,000 cells/well) for 18 h, 37° C., 5% CO2, before infection with 100 vp/cell. Wells were harvested 24 and 72 h post infection, and DNA purified using PureLink genomic DNA mini kit (Invitrogen, #K182001) according to the manufacturer's protocol. Total viral genomes were quantified by qPCR against EnAd hexon using specific primer-probe set

```
(primers: TACATGCACATCGCCGGA/CGGGCGAACTGCACCA,
probe: CCGGACTCAGGTACTCCGAAGCATCCT).
```

Microscopy

Brightfield and fluorescence images were captured on a Zeiss Axiovert 25 microscope. Time lapse videos were obtained to observe viral or T cell-mediated lysis of target cells by EnAd or EnAd-CMVEpCAMbispecific T-cell activator. Uninfected cells were used as a negative control. NHDF cells were stained with CellTracker Orange CMTMR Dye (Life Technologies, #C2927) and CD3+ cells were stained with CellTrace Violet Cell Proliferation Kit (Life Technologies, #C34557) following manufacturer's protocols. Dyed NHDF were plated in a 24-well plate at 7,500 cells/well in co-culture SKOV3 at 13,500 cell/well. Plates were incubated for 18 h, 37° C., 5% CO2. Cells were then treated with 300 ng/mL EpCAM bispecific T-cell activator or infected with 100 vp/cell of EnAd or EnAd2.4-CMV-EpCAMbispecific T-cell activator or left untreated. After 2 h incubation, 100,000 dyed CD3+ were added to necessary wells, in addition to 1.5 uM CellEvent Caspase 3-7 reagent (Life Technologies, #C10423). Images were captured on a Nikon TE 2000-E Eclipse inverted microscope (10× optical objective) at intervals of 15 min covering a period of 96 h. Time-lapse videos (12 frames/second) were generated using ImageJ) software.

Statistics

In all cases of more than two experimental conditions being compared, statistical analysis was performed using a One-way ANOVA test with Tukey's Post Hoc analysis. All data is presented as mean±SD. The significant levels used were P=0.01-0.05 (*), 0.001-0.01 (), 0.0001-0.001 (*). All in vitro experiments were performed in triplicate, unless stated otherwise.

Figure 45:
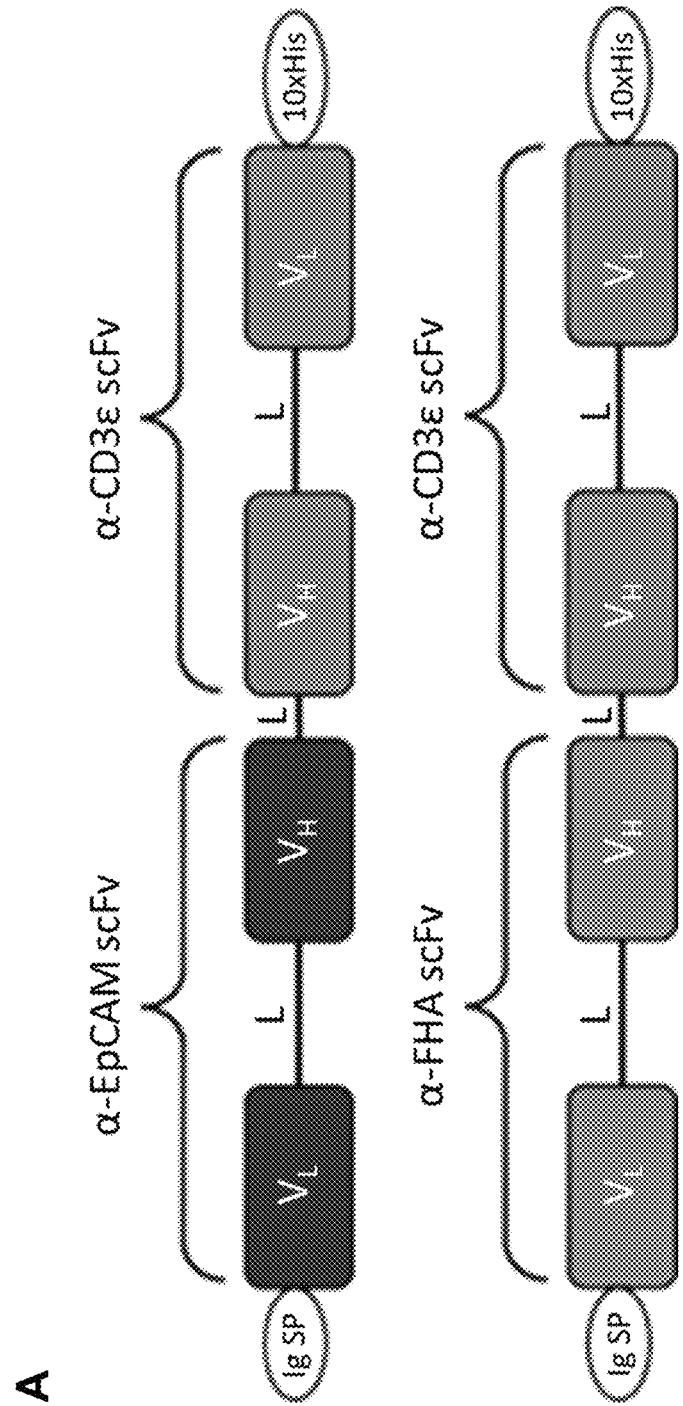
FIG. 45 Characterisation of EpCAM Bispecific T-cell Activator and its effects on PBMC-derived T cells (A) Schematic of the structure of the EpCAM-targeted Bispecific T-cell activator and non-specific control Bispecific T-cell activator. The VL and VH domains are connected with flexible peptide linkers (L) rich in serine and glycine for flexibility and solubility. Ig SP, Light chain immunoglobulin signal peptide; 10His, decahistidine affinity tag. (B) Induction of activation markers CD69 and (C) CD25 on CD3-purified PBMC cultured alone or with DLD cells (5:1) in the presence of bispecific T-cell activators-containing supernatants. CD69 and CD25 were measured by flow cytometry after 24 h of co-culture. Significance was assessed versus IgG isotype (D) Percent of IFNγ-positive T-cells after 6 h in co-culture with DLD cells (5:1) and bispecific T-cell activator-containing supernatants. (E) Proliferation, represented by division index and percentage of parental T cell population entering proliferation, of CFSE-stained T-cells in co-culture with DLD cells (5:1) and bispecific T-cell activator-containing supernatants. Fluorescence was measured by flow cytometry 5 days after co-culture. Division index was modelled using FlowJo proliferation tool. (F) Degranulation of T-cells, measured by CD107a externalisation, in co-culture with DLD cells (5:1) and bispecific T-cell activator-containing supernatants. Externalisation was assessed by co-culture with a CD107a-specific antibody for 6 h followed by flow cytometry analysis. (G) Cytokine levels were measured by LEGENDplex human Th cytokine panel using supernatants from co-cultures of T-cells with DLD cells (5:1) in the presence of bispecific T-cell activator-containing supernatants for 48 h. Each condition was measured in biological triplicate and data represented as mean±SD. Significance was assessed versus untreated unless stated otherwise using a one-way ANOVA test with Tukey's Post Hoc analysis, *p<0.05, p<0.01, *p<0.001.

Example 18—Generation and Production of a Bispecific T-Cell Activator Targeting EpCAM A bispecific T-cell activator targeting EpCAM was engineered by joining two scFv specific for CD3E and EpCAM with a flexible glycine-serine (GS) linker. A control bispecific T-cell activator, recognising CD3ε and an irrelevant antigen (the filamentous haemagglutinin adhesin (FHA) of *Bordetella pertussis*) was also produced. Both bispecific T-cell activators were engineered to contain an N-terminal signal sequence for mammalian secretion and a C-terminal decahistidine affinity tag for detection and purification (FIG. 45, panel A). To characterise the functionality of the recombinant bispecific T-cell activators, they were cloned into expression vectors under transcriptional control of the CMV immediate early promoter (pSF-CMV-EpCAMbispecific T-cell activator and pSF-CMV-Controlbispecific T-cell activator, respectively).

Adherent HEK293 cells (HEK293A) were transfected with the expression vectors and supernatants harvested and concentrated 50-fold for further analysis. To estimate the amount of bispecific T-cell activator produced, samples were serially diluted and evaluated, using anti-His, in a dot blot using decahistidine-tagged cathepsin D as a standard. In this way it was possible to estimate the level of bispecific T-cell activators produced into the supernatant to be approximately 20 µg/mL at 48 h post transfection (of 1.8e7 HEK293A cells) (FIG. 46, panel A). Specific binding of the EpCAM bispecific T-cell activator and not the control bispecific T-cell activator to recombinant EpCAM protein was demonstrated by ELISA (FIG. 46, panel B).

Example 19—Characterisation of Human T-Cell Activation by Recombinant EpCAM Bispecific T-Cell Activator The ability of recombinant EpCAM bispecific T-cell activator protein to activate PBMC-derived T cells was evaluated by adding unstimulated human primary CD3+ cells to a culture of human DLD colorectal carcinoma cells, which are known to express EpCAM on their surface (Karlsson et al, 2008). Addition of 2.5 ng/ml EpCAM bispecific T-cell activator (as supernatant from transduced HEK293A cells) led to a significant increase in T cell activation markers CD 69 and CD25 (FIG. 45, panels B & C), whereas the control bispecific T-cell activator had no effect.

Exposure of CD3 cells to the EpCAM bispecific T-cell activator in the absence of tumour cells gave a very modest increase in CD 69 and CD25, and this indicates that antibody-mediated clustering of CD3 is essential for full activation by this anti-CD3 binding. T cells stimulated by the EpCAM bispecific T-cell activator in the presence of tumour cells also showed a significant increase in the production of gamma interferon (FIG. 45, panel D) and cell proliferation (FIG. 45, panel E) whereas the control bispecific T-cell activator had no effect. The aim of T cell activation is to cause degranulation-mediated cytotoxicity, and expression of surface CD107a/LAMP1 (indicating degranulation, Aktas et al.) was strongly upregulated by the EpCAM bispecific T-cell activator but not by control (FIG. 45, panel F).

The release of cytokines following EpCAM bispecific T-cell activator-mediated activation of PB MC-derived T cells in the presence of DLD cells was characterised by flow cytometry using a cytokine bead array. As before the control bispecific T-cell activator showed little activity, although the EpCAM bispecific T-cell activator triggered release of several cytokines, including high levels of IL-2, IL-6, IL-10, IL-13, gamma interferon and TNF (FIG. 45, panel G). Production of IL-2, gamma interferon and TNF are generally associated with a Th1 response, whereas IL-6 and IL-10 are more often linked to a Th2 response (Mosmann & Sad, 1996).

Example 20—Specificity of Recombinant EpCAM Bispecific T-Cell Activator

Most human epithelial cells express EpCAM, so to assess whether the effect of the EpCAM bispecific T-cell activator was antigen-specific, Chinese Hamster Ovary cells (CHO cells) were engineered using a lentiviral vector to express human EpCAM on their surface. In the presence of EpCAM bispecific T-cell activator and CHO-EpCAM cells, exogenously added PBMC-derived T cells showed strong activation (assessed by CD25 expression see FIG. 47, panel A) and associated cytotoxicity (FIG. 47, panel B) that was not seen with parental CHO control cells or control bispecific T-cell activators. This indicates that the cytotoxicity of the EpCAM bispecific T-cell activator is antigen-specific.

Figure 47:
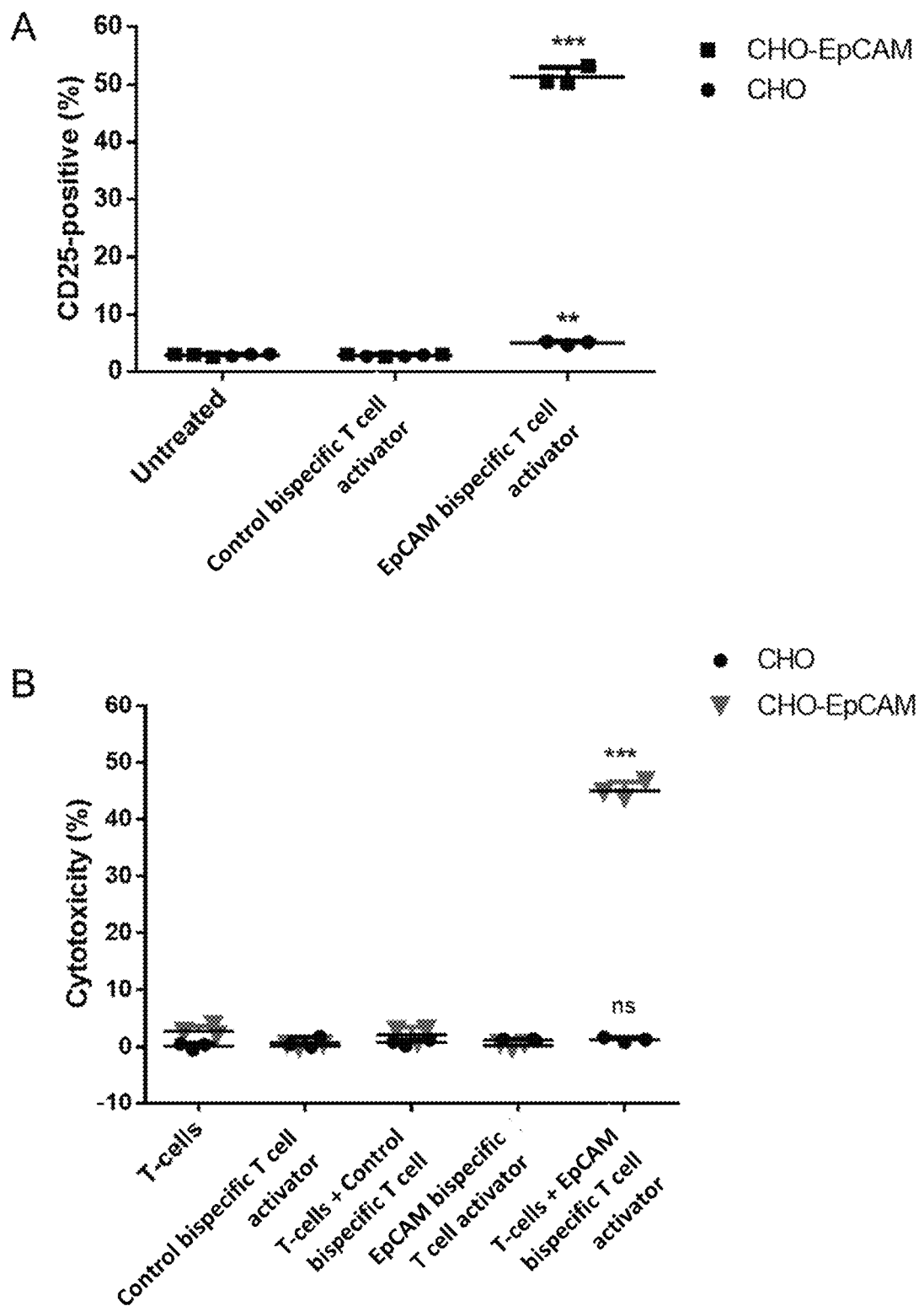
FIG. 47 Assessment of antigen-specificity of EpCAM Bispecific T-cell Activator-mediated T cell cytotoxicity
- (A) Induction of activation marker CD25 on CD3+ T-cells in co-culture with CHO or CHO-EpCAM cells (5:1) and bispecific T-cell activator-containing supernatants, measured by FACS analysis after 24 h of co-culture. (B) Cytotoxicity of CHO or CHO-EpCAM cells cultured with bispecific T-cell activator-containing supernatants alone or in coculture with T-cells. Cytotoxicity was assessed by release of LDH into the culture supernatants after 24 h of incubation. (C) Cytotoxicity of multiple EpCAM-positive carcinoma cells after 24 h in co-culture with T-cells (1:5) and bispecific T-cell activator-containing supernatants. Viability was measured by MTS assay after 24 h of co-culture. (D) Levels of EpCAM expression (N=1) assessed by FACS analysis of EpCAM-positive cell lines in (C), compared to background fluorescence measured by using an isotype control antibody. (AC) Each condition was measured in biological triplicate and represented as mean±SD. Significance was assessed versus untreated or T-cell only controls using a one-way ANOVA test with Tukey's Post Hoc analysis, *p<0.05, p<0.01, *p<0.001.

We then assessed whether the EpCAM bispecific T-cell activator would kill a range of tumour cells, and whether the level of EpCAM bispecific T-cell activator-mediated cytotoxicity observed was dependent on the density of EpCAM expression. Cytotoxicity of T cells in the presence of the EpCAM bispecific T-cell activator was measured in six different carcinoma cell lines, with greatest cytotoxicity observed in DLD and A431, and least in A549 and PC3 (FIG. 47, panel C). This showed a loose association with the surface levels of EpCAM (determined by flow cytometry), where A549 and PC3 cells showed the lowest levels and DLD the highest (FIG. 47, panel D). This suggests that the presence and level of EpCAM expression do influence the degree of cytotoxicity, although other factors (perhaps the intrinsic resistance of cells to granzyme-mediated apoptosis) also play a role in determining the overall level of cell killing.

Example 21—Bispecific T-Cell Activator Mediated Activation of CD4+ and CD8+ T Cell Subsets To determine which T cell types are activated by the EpCAM bispecific T-cell activator, PB MC-derived T cells were incubated with DLD cells and activated using the bispecific T-cell activator prior to flow analysis. Both CD4+ and CD8+ cells showed high levels of expression of CD69 and CD25 (FIG. 49, panel A), although the percentage of activated CD4 cells was generally slightly greater. EpCAM bispecific T-cell activator-mediated T cell proliferation was assessed using CFSE stain (FIG. 49, panel B), and degranulation by expression of CD197a/LAMP1 (FIG. 49, panel C) and again similar levels of activation were seen for both CD4+ and CD8+ cells. Finally, levels of tumour cell cytotoxicity achieved were compared using EpCAM bispecific T-cell activator to activate purified CD 4+ and CD8+ subsets. All T cell preparations showed similar cytotoxicity (FIG. 49, panel D), indicating that both CD4+ and CD8+ cells can contribute to the bispecific T-cell activator-mediated cytotoxicity observed.

Example 22—Expression of the EpCAM Bispecific T-Cell Activator from Oncolytic Adenovirus, EnAdenotucirev EnAdenotucirev (EnAd) is an oncolytic adenovirus, a chimera of group B type 11 and type 3 adenovirus with a mosaic E2B region, a nearly complete E3 deletion and a smaller E4 deletion mapped to E4orf4 (Kuhn 2008). Currently undergoing several early phase clinical trials for treatment of cancer, the virus combines good systemic pharmacokinetics and promising clinical activity with the possibility to encode and express transgenes (Calvo 2014, Boni 2014). The EpCAM bispecific T-cell activator was encoded within EnAd immediately downstream of the fibre gene, using a shuttle vector inserted into the virus backbone by Gibson assembly (FIG. 18). The bispecific T-cell activator was placed either under transcriptional control of a CMV immediate early promoter (EnAd-CMV-EpCAM bispecific T-cell activator), or was placed downstream of a splice acceptor site for the adenovirus major late promoter (MLP; EnAd-SA-EpCAM bispecific T-cell activator). In the former configuration the bispecific T-cell activator should be expressed whenever the virus successfully infects a cell, whereas expression from the MLP splice acceptor site will only occur when the MLP is activated in cells that are permissive to virus replication. A control bispecific T-cell activator (recognising CD3 and FHA) was also introduced to create two corresponding control viruses.

The viruses were cloned, rescued in HEK293A cells, and a large batch of each was prepared in a hyperflask and purified twice by caesium chloride banding. Infection of DLD with parental EnAd and the recombinant bispecific T-cell activator viruses yielded similar amounts of viral genomes (measured by qPCR) at all timepoints tested, indicating the bispecific T-cell activator transgene does not interfere with the viral replication kinetics (FIG. 51, panel A). Next we investigated the replication and oncolytic properties of the viruses in the absence of human T-cells. DLD cells were infected with virus batches at increasing virus particles (vp)/cell, and the cytotoxicity measured by MTS assay on day 5. All of the recombinant viruses, including those with EpCAM and control bispecific T-cell activators, regulated by the CMV promoter or splice acceptor, showed cytotoxic activity indistinguishable from the parental virus, showing that the genetic modification had not changed the intrinsic oncolytic activity of the virus (FIG. 51, panel B).

To assess bispecific T-cell activator expression and secretion, the bispecific T-cell activator-expressing EnAd viruses were used to infect HEK293A cells, and 72 h supernatants were examined by western blotting using an anti-His antibody. As shown in FIG. 51, panel C, all four viruses (two expressing the control bispecific T-cell activator and two expressing the EpCAM bispecific T-cell activator) showed similar levels of bispecific T-cell activator secreted into the supernatant.

Example 23—Selective Killing of EpCAM Positive Cells by Virally Produced EpCAM Bispecific T-Cell Activator The supernatants from EnAd-EpCAM bispecific T-cell activator-infected HEK293A cells were added to cultures of CHO and CHO-EpCAM cells, either with or without PBMC-derived T cells; T cell activation and cytotoxicity to the CHO/CHO-EpCAM cells was measured after 24 h. In the case of CHO cells, there was no increase in T cell expression of CD25 (FIG. 51, panel D) nor any cytotoxicity observed with any treatment (FIG. 51, panel E). However, T cells I incubated with the CHO-EpCAM cells showed substantial increases in CD25 expression using supernatants from HEK293A cells that had been infected with either EnAd-CMV-EpCAM bispecific T-cell activator or EnAd-SA-EpCAM bispecific T-cell activator viruses (FIG. 51, panel D). As expected this translated into selective cytotoxicity to CHO-EpCAM cells only when T cells were added in the presence of supernatant from 293A cells that had been infected with either EnAd-CMV-EpCAM bispecific T-cell activator or EnAd-SA-EpCAM bispecific T-cell activator viruses (FIG. 51, panel E). Crucially there was no cytotoxicity in the absence of T cells, or when using supernatants from HEK293A that cells had been infected with EnAd expressing the control bispecific T-cell activator.

Example 24—Superior Cytotoxicity of EnAd Expressing EpCAM Bispecific T-Cell Activator EnAd kills most carcinoma cells quickly by direct oncolysis (Kuhn 2008), although some cells—notably SKOV3 ovarian carcinoma cells—are partially resistant and killed more slowly. We therefore reasoned that the consequences of arming EnAd to secrete EpCAM bispecific T-cell activator, leading to cytotoxic activation of T cells might be particularly evident in SKOV3 cells. Cells were therefore exposed to virus (100 vp/cell) 24 h after seeding and cell death monitored by xCELLigence system. PBMC-derived T cells were added (or not) to the SKOV3 cell culture 2 h later. In the absence of T cells, the tumour cells grew for approximately 72 h (manifest by the increasing Cell Index signal in FIG. 53, panel A) but cell growth then reached a plateau and remained stable, independent of virus infection, up until at least 160 h). All tested viruses, including parental EnAd, induced no observable target cell cytotoxicity during the time measured. However, when co-cultured with PBMC-derived T cells, both the CMV- and SA-EpCAM bispecific T-cell activator-armed viruses induced rapid SKOV3 lysis, with CMV-driven induced lysis within 16 h, and SA within 44 h following addition of T cells (FIG. 53, panel B). Importantly, parental EnAd or the non-specific bispecific T-cell activator control viruses demonstrated no target cell lysis in this time frame even with the addition of Tcells. This result was confirmed by LDH assay, in which co-cultures identical to above were set up, with cytotoxicity measured at 24, 48 and 96 h post-infection (FIG. 48). These results are further supported by similar findings in DLD cells in which EpCAM bispecific T-cell activator expressing viruses induced cytotoxicity at a significantly quicker rate than the control bispecific T-cell activator viruses (FIG. 50, panels A & B).

Figure 50:
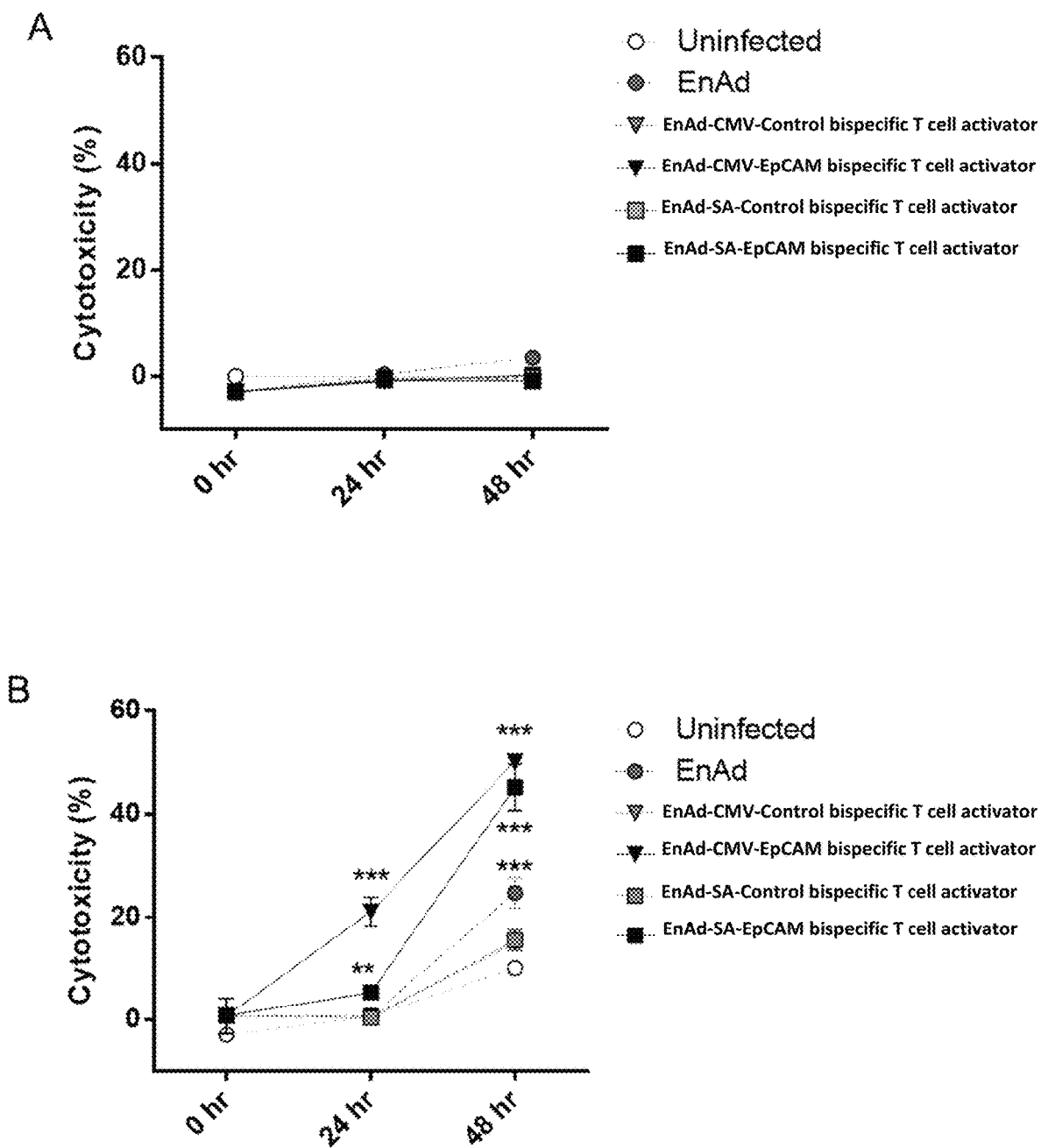
FIG. 50 Cytotoxicity and T cell activation by EnAd-expressing EpCAM Bispecific T-cell Activator in DLD cells
Cytotoxicity for infected DLD cells in absence (A) or presence of T-cells (B). DLD cells were infected and co-cultured with T-cells and cytotoxicity was measured by LDH release at the specified timepoints. (C-D) T-cells from (B) were harvested and stained for activation markers CD69 (C) or CD25 (D) and analysed via flow cytometry. (E-F) Quantification of EpCAM bispecific T-cell activators-produced from DLD cells infected with recombinant viruses. Standard curve of LDH released (Abs) of DLD in co-culture with CD3+ cells and varying known quantities of recombinant EpCAM bispecific T-cell activators (E). In parallel, co-cultures were incubated with diluted supernatants (10,000-fold) from 3 day infected DLD cells (F). Standard curve allowed the approximate determination of EpCAM bispecific T-cell activators produced at 165 µg and 50 µg per million DLD cells for EnAd-CMV-EpCAMbispecific T-cell activators and EnAd-SA-EpCAMbispecific T-cell activators, respectively. (G) Graph showing quantification of EpCAM Bispecific T cell activator produced from DLD cells infected with recombinant viruses. Significance was assessed by comparison to uninfected control wells using a one-way ANOVA test with Tukey's Post Hoc analysis, ***p<0.001

To confirm that target cell cytotoxicity is mediated via T cell activation, CD3 cells were harvested at each timepoint and activation status determined by CD69 and CD25 expression, demonstrating similar kinetics of expression as observed for cytotoxicity (FIG. 53, panels C & D, FIG. 50, panels C & D). The approximate quantity of EpCAM bispecific T-cell activator produced from infected DLD cells was determined by comparing cytotoxicity (Abs490) induced by infected DLD supernatants to the cytotoxicity induced by known quantities of recombinant bispecific T-cell activator (i.e. creation of a standard curve (Abs490)). DLD in co-culture with CD3-purified PBMC (1:5) were incubated with recombinant bispecific T-cell activator (FIG. 50, panel E) or infected DLD supernatant (FIG. 50, panel F) and LDH release was measured at 24 h, This allowed us to determine that EpCAM bispecific T-cell activator was produced at 165 µg and 50 µg per million DLD for EnAd-CMV-EpCAMbispecific T-cell activator and EnAd-SAEp-CAMbispecific T-cell activator, respectively. The EC50 for the EpCAM bispecific T-cell activator is 7.4 ng/ml (FIG. 50, panels E & F), and therefore EpCAM bispecific T-cell activator is produced by the recombinant virus at levels that are likely to reach therapeutic doses.

Cytotoxicity of EpCAM bispecific T-cell activator-expressing EnAd was visualised by time lapse video microscopy. SKOV3 tumour cells (unlabelled) were co-incubated with normal human fibroblasts (EpCAM-negative, labelled red, serving as non-target control cells) and PBMC-derived T cells (labelled blue) in the presence of a caspase stain (CellEvent Caspase 3-7 reagent produces a green stain when caspases are activated). Again the combination of EpCAM bispecific T-cell activator-expressing EnAd, combined with exogenous T cells, gave dramatic cytotoxicity to the SKOV3 tumour cells, which showed strong induction of apoptosis when infected with EnAd-CMV-EpCAMbispecific T-cell activator, but not parental EnAd. Importantly, the EpCAM-negative NHDF in co-culture remained viable throughout Representative fluorescent images at different time points from the SKOV3 videos are shown in FIG. 53, panel E. Equivalent time lapse videos showing DLD cells (which are intrinsically more sensitive to the virus) cocultured with NHDF are also shown.

Figure 55:
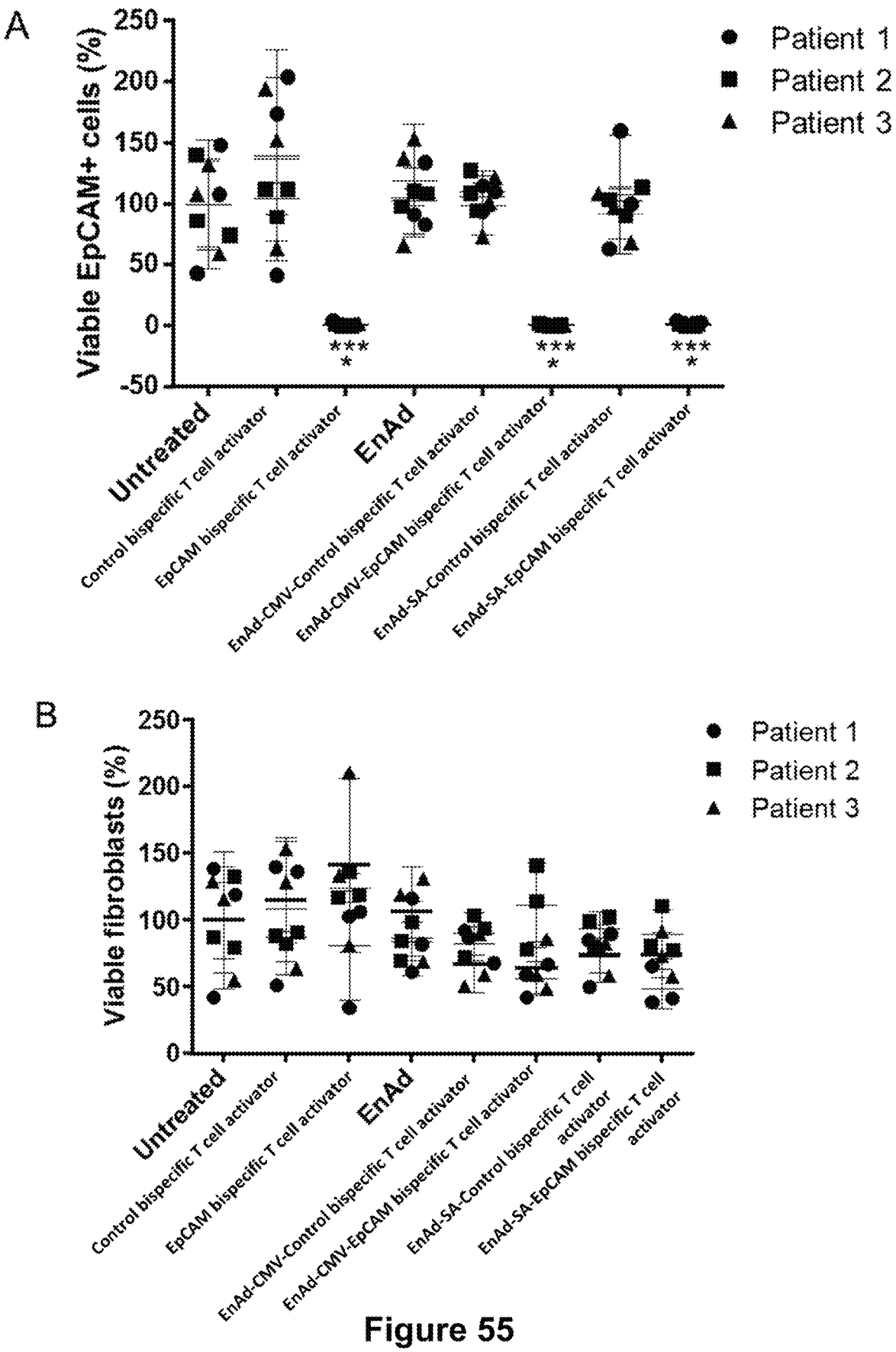
FIG. 55 EnAd expressing EpCAM Bispecific T-cell Activator can selectively kill primary human tumour cells from chemotherapy-pretreated patients
  (A) Cytotoxicity of EpCAM+ cells or (B) FAP+ fibroblasts, first isolated from three patients' ascites and expanded ex vivo, then incubated with recombinant bispecific T-cell activators, or infected with EnAd or recombinant virus. Cytotoxicity was measured by flow cytometry after 5 days. (C) Induction of activation marker CD25 on CD3-positive T-cells cultured with ascites derived EpCAM+ and FAP+ cells from (A+B). Each condition was measured in biological triplicate and represented as mean±SD. Significance was assessed by comparison to untreated using a one-way ANOVA test with Tukey's Post Hoc analysis, *p<0.05, p<0.01, *p<0.001.

Example 25—EpCAM Bispecific T-Cell Activator can Overcome Immune Suppression, Activate Endogenous T Cells and Kill Endogenous Tumour Cells within Malignant Peritoneal Ascites Three clinical samples of malignant peritoneal ascites samples containing EpCAM-positive tumour cells and primary fibroblasts (as control, non EpCAM-expressing cells) were expanded ex vivo and the mixed primary cell populations were incubated with PBMC-derived T-cells and treated with free bispecific T-cell activator or 100 vp/cell EnAd-EpCAMbispecific T-cell activator in culture medium. After 72 h, the level of EpCAM-positive target cells (FIG. 55, panel A) or non-target fibroblast activation protein (FAP)-positive fibroblasts (FIG. 55, panel B) were measured by flow cytometry. Activation of T cells was analysed by measuring CD25 expression (FIG. 55, panel C). The free EpCAM bispecific T-cell activator and the EpCAM bispecific T-cell activator-expressing viruses induced T-cell activation, leading to a depletion of EpCAM-positive tumour cells, with primary FAP-positive (EpCAM-negative) fibroblasts showing no change in numbers. This was observed in all the patients' samples, and none of the other treatments showed any significant effects. This demonstrates that the EpCAM bispecific T-cell activator (or oncolytic virus encoding it) can mediate activation and selective cytotoxicity by PBMC-derived T cells to human ovarian ascites tumour cells.

Figure 56:
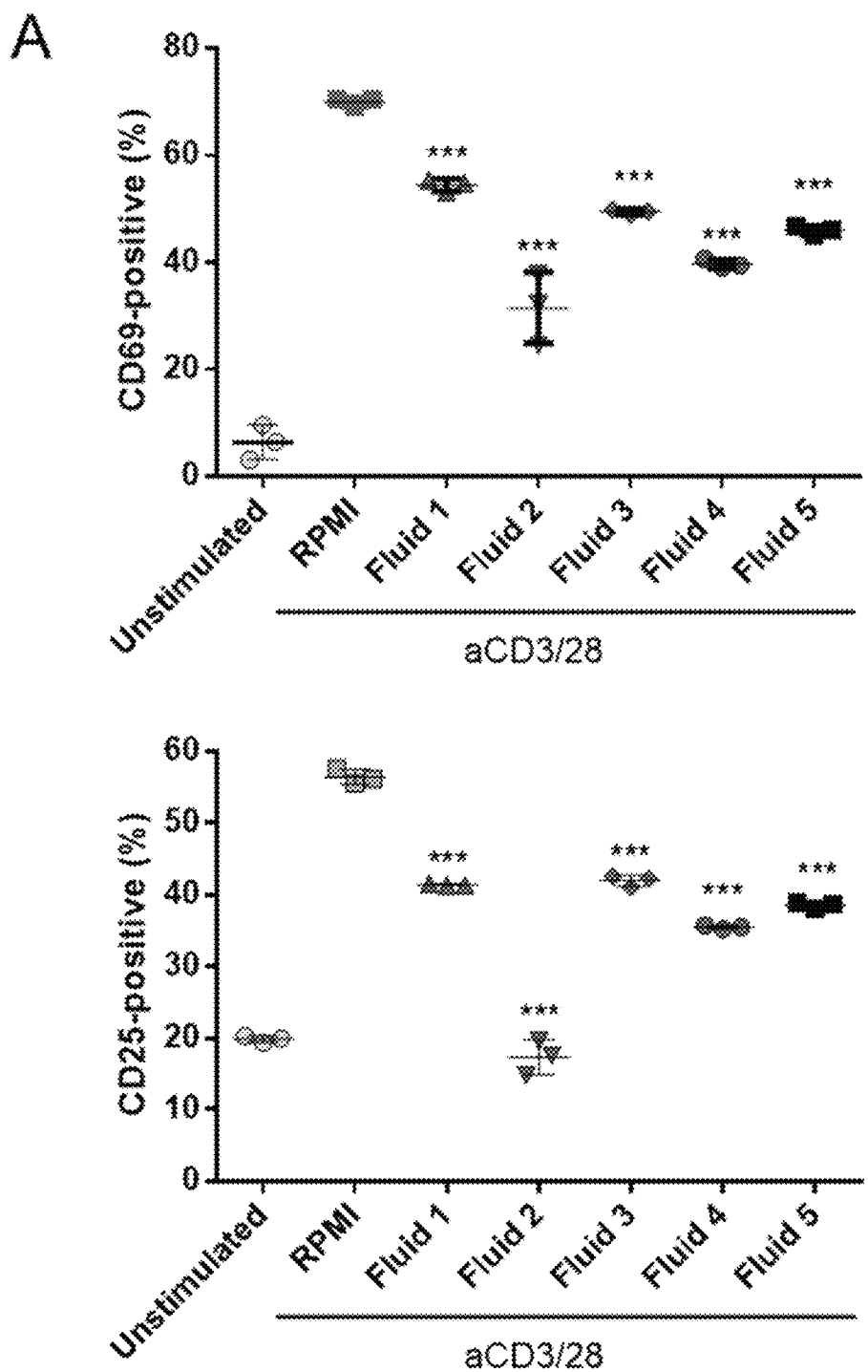
FIG. 56 EpCAM Bispecific T-cell Activators can overcome immune suppressive effects of ascites fluid and activate endogenous T cells
  (A-B) PBMC-derived T cells were incubated with anti-CD3 antibodies in RPMI culture medium or the presence of 100% peritoneal ascites fluid from five ovarian cancer patients. (A) At 24 h induction of T cell activation markers CD69 and CD25 were analysed, and (B) degranulation of T-cells measured by CD107a externalisation, using flow cytometry. (C) Viability of MCF7 cells were monitored in real-time over 60 h by xCELLigence-based cytotoxicity assay. MCF7 cells were seeded and incubated with control or EpCAM bispecific T-cell activators at 25 h, in the presence of RPMI medium or 100% ascites fluid #1 or #2. Untreated cells served as a negative control. CD3-purified PBMC (5:1) were added at the same time and impedance was measured at 15 min intervals. (D) Endogenous unpurified total cells from peritoneal ascites were incubated in 100% ascites fluid in the presence of free EpCAM or control bispecific T-cell activators. After 24 h, the total cell population was harvested, and the number of CD3+/CD69+ and CD3+/CD25+ cells measured by flow cytometry. Each condition was measured in biological triplicate and represented as mean±SD. Significance was assessed by comparison to RPMI (A+B), untreated (D) or control bispecific T-cell activators (E) using a oneway ANOVA test with Tukey's Post Hoc analysis, *p<0.05, p<0.01, *p<0.001.

Malignant exudates likely represent an environment of potential immune tolerance with suppressed immune responses commonly observed in patients with late-stage metastatic cancer. To test this hypothesis we polyclonally stimulated PBMC-derived T cells with anti-CD3 antibodies in culture media or the presence of 100% ascites fluid from five patients with peritoneal malignancies. Whereas in RPMI medium the anti-CD3 antibody gave approximately 50% of T cells positive for both CD25 and CD 69, the presence of ascites fluid appeared to attenuate the activation of T-cells as determined by decreased antibody-mediated elevation of CD69/CD25 expression, and this was particularly noticeable for patient fluid #2 (FIG. 56, panel A). This supports our notion that components of ascites fluid may exert an immune suppressive or tolerising effect. However, this attenuation in the increase of activation markers did not correlate with a suppression of T-cell degranulation, with CD107a externalisation in ascites fluid similar to that in culture medium (FIG. 56, panel B). It follows that bispecific T-cell activators may be able to bypass tumour microenvironment-associated mechanisms of T-cell immunosuppression (Nakamura & Smyth, 2016).

We therefore investigated the ability of PBMC-derived T cells and EpCAM bispecific T-cell activator to mediate target cell cytotoxicity in the presence of immunosuppressive ascites fluid. T-cells incubated with ascites fluid 1 and 2 induced similar lysis of the human breast adenocarcinoma MCF7 cell line as when in RPMI culture medium (measured using xCELLigence), although the cytotoxicity showed a delay of about 8 h in the presence of patient ascites fluid #2 (FIG. 56, panel C). In addition to the immune suppressive fluid and tumour cells present, ascites contain tumour-associated lymphocytes and supporting cells of the tumour stroma, providing a unique tumour-like model system to test bispecific T-cell activator-mediated activation of endogenous patient-derived T-cells. Following a 24 h incubation of total endogenous cells and the ascites fluid with the free recombinant bispecific T-cell activator, activation of patient T cells was assessed (FIG. 56, panel D). In this highly clinically-relevant setting the EpCAM bispecific T-cell activator (but not the control counterpart) induced CD69 and CD25 expression, albeit CD25 at lower levels when the experiment was performed in 100% ascites fluid than in simple medium. These data suggest that the EpCAM bispecific T-cell activator can overcome at least some of the immune suppressive effects of peritoneal ascites fluid to activate endogenous T cells. Cytotoxicity was assessed by measuring release of LDH, and the bispecific T-cell activator caused a significant rise both when the experiment was performed in medium and also in 100% ascites fluid. This indicates that some of the ascites cells had been killed by bispecific T-cell activator-mediated cytotoxicity, although given the multiple cell types present in primary ascites it is not possible to define what proportion of tumour cells are killed.

Figure 54:
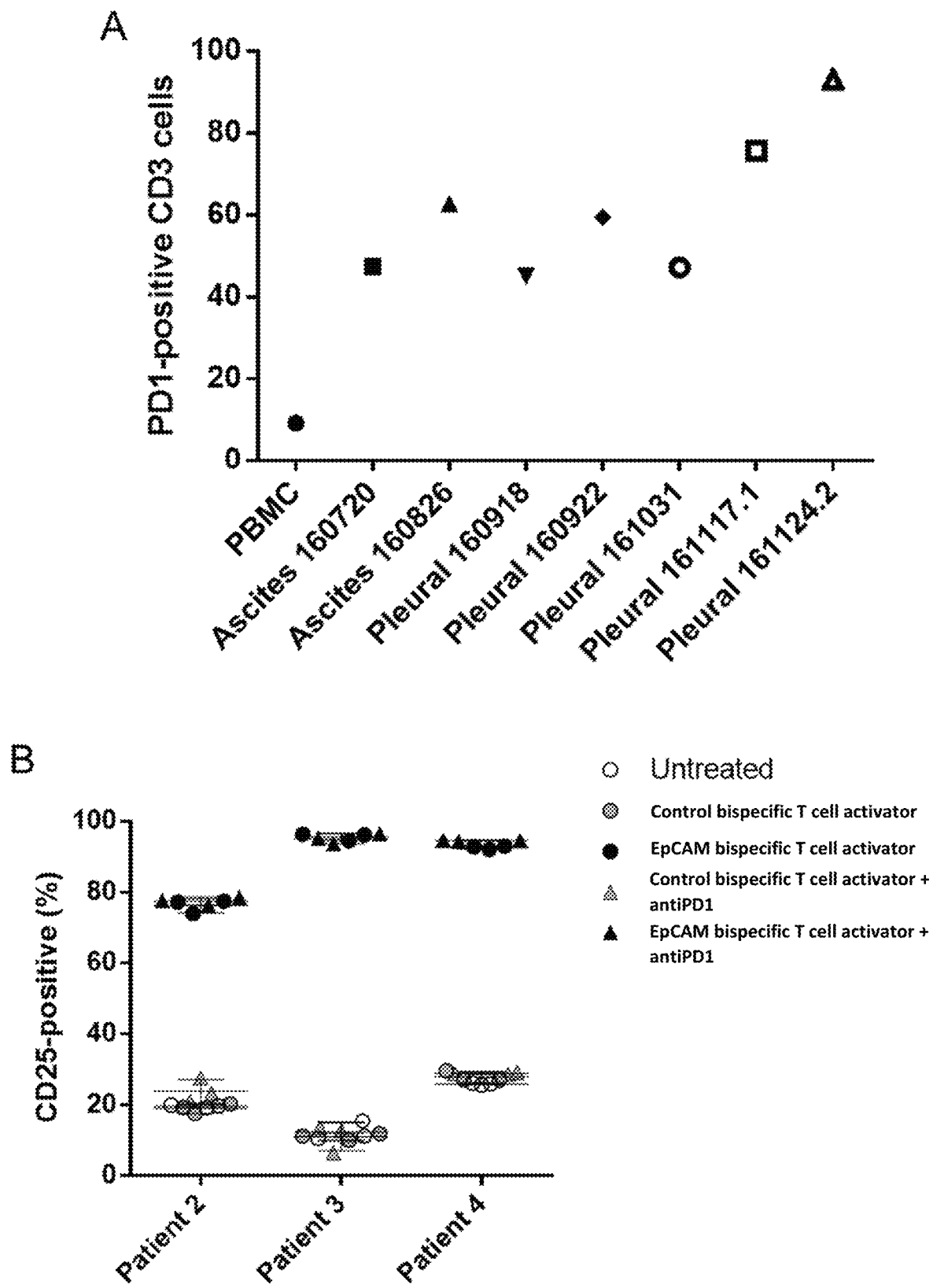
FIG. 54 Expression of PD1 and the effect of PD1 antibodies on Bispecific T-cell Activator-mediated T cell activation
  (A) The expression of PD1 by endogenous T cells following their initial isolation from pleural effusions was assessed by flow cytometry. (B-D) Unpurified total cells from pleural effusions (from three different patients) were incubated in 100% fluid from the same pleural exudate in the presence of free bispecific T-cell activators, EnAd or recombinant virus. After 5 days, the total cell population was harvested, and the number of (B) CD3+ T cells and those which were (C) CD25+ were quantified. (D) The number of EpCAM+ cells was measured using flow cytometry. Significance was assessed by comparison to untreated control wells using a one-way ANOVA test with Tukey's Post Hoc analysis, ***p<0.001

Example 26—EnAd Expressing EpCAM Bispecific T-Cell Activator can Activate Endogenous T Cells to Kill Endogenous Tumour Cells within Malignant Pleural Exudates To study the effects of the EpCAM bispecific T-cell activator-expressing viruses in another clinically relevant setting, we obtained several samples of pleural exudates from patients with a range of malignancies. At initial screening (an example is shown in FIG. 52), samples considered suitable for further analysis were those containing CD3 and EpCAM-positive cells. We also assessed the expression of PD1 by endogenous T cells following their initial isolation, and whereas only 10% of PBMC-derived T cells expresses PD1, all the malignant effusion samples T cells were at least 40% positive for PD1 and reached sometimes as high as 100% (FIG. 54, panel A). Unpurified total cells (isolated by centrifugation and resuspended) were incubated at fixed concentrations in 100% pleural effusion fluid in the presence of 500 ng/mL free EpCAM bispecific T-cell activator or 100 vp/cell virus encoding bispecific T-cell activator. After 5 days, the total cell population was harvested, and the total number of CD3+ cells (FIG. 57, panel A) was measured.

Compared to untreated controls, only samples receiving the free EpCAM bispecific T-cell activator or EnAd encoding EpCAM bispecific T-cell activator showed T cell proliferation. This confirms that the EpCAM bispecific T-cell activator was binding to the EpCAM target and crosslinking CD3 to stimulate endogenous T cells. The expression level of CD25 on CD3 cells was also determined (FIG. 57, panel B). The free EpCAM bispecific T-cell activator induced significant T-cell activation of tumourassociated lymphocytes (assessed by CD25 expression) in all patients' samples, even within the likely immune-tolerising environment of the pleural effusion fluid. The addition of an anti-PD1 blocking antibody had no effect on EpCAM bispecific T-cell activator mediated activation of T cells in this setting (FIG. 54, panels B & C). There was noticeable variation between patients (although little between samples from the same patient), with activation ranging from 50% to 90% dependent on the donor. Similarly, samples treated with EnAd expressing the EpCAM bispecific T-cell activator showed high activation in some patients (ranging from 10-20% up to 80%, for both EnAd-CMV-EpCAM bispecific T-cell activator and EnAd-SA-EpCAM bispecific T-cell activator).

Interestingly, the patient showing the lowest bispecific T-cell activator-mediated activation also showed the lowest level of background T cell activation. Parental EnAd, or EnAd expressing control bispecific T-cell activators, or free control bispecific T-cell activators caused no stimulation above background.

We assessed the ability of the bispecific T-cell activator-expressing viruses to mediate EpCAM-targeted cytotoxicity by measuring residual levels of EpCAM positive cells by flow cytometry at the end of the five day incubation (FIG. 57, panel C). The free EpCAM bispecific T-cell activator, and the two viruses encoding EpCAM bispecific T-cell activator, caused a marked depletion of autologous EpCAM-expressing cells in every case, whereas the other treatments had little or no effect on the level of EpCAM-positive cells. In the case of Sample #1 there is a slightly decreased viability with all EnAd based viruses compared to the untreated control, and this is likely to represent the effects of direct viral oncolysis. In conjunction with the lack of influence of the PD1 blocking antibody on T cell activation, it had no effect on EpCAM bispecific T-cell activator mediated killing of target cells, with near complete cytotoxicity of EpCAM+ cells (patients 2, 3 & 4) in the absence of the PD1 blocker (FIG. 54, panel D).

The different effects of parental EnAd and EnAd-CMV-EpCAM bispecific T-cell activator are shown by microscopy in FIG. 57, panel D, where expression of the bispecific T-cell activator decreases the presence of tumour cells and expands the T cell population. The associated flow cytometry plots confirm the substantial expansion and activation of T cells following treatment with the EpCAM bispecific T-cell activator-expressing virus.

Finally the effects of the various treatments were characterised by measuring the levels of key cytokines produced using a LEGENDplex protein array (FIG. 57, panel E). By far the greatest fold increases were in gamma interferon, which rose nearly 1000-fold following treatment with the free EpCAM bispecific T-cell activator or EnAd encoding EpCAM bispecific T-cell activator. These two treatments also caused approximately 10-fold increases in expression of IL-5, IL-13, tumour necrosis factor (TNF), IL17A and IL17F, characteristic of activated T cells. EnAd alone (or expressing the control bispecific T-cell activator) also caused a 10-fold rise in gamma interferon, but otherwise no treatments caused any appreciable changes in cytokine expression.

Example 27—Discussion

Oncolytic viruses offer an intriguing new strategy to combine several therapeutic modalities within a single targeted, self-amplifying, agent (Keller & Bell, 2016; Seymour & Fisher, 2016). As they replicate selectively within cancer cells and spread from cell to cell, some oncolytic viruses are thought to mediate cell death by non-apoptotic death pathways (Ingemarsdotter et al, 2010; Li et al, 2013), as part of the process allowing virus particles to escape from dying cells. EnAd, in particular, kills cells by a pro-inflammatory process known as oncosis or ischemic cell death (Dyer, 2017). This non-apoptotic death mechanism causes release of several pro-inflammatory cellular components, such as ATP, HMGB1 and exposure of calreticulin (known as damage-associated molecular patterns, DAMPs)(Weerasinghe & Buja, 2012), and is likely pivotal to the ability of the virus to promote an effective anticancer immune response. In addition to the consequences of direct lysis, however, viruses offer the potential to encode and express other anticancer biologics, obviating delivery challenges and ensuring the biologic achieves its highest concentration within the tumour microenvironment Imlygic encodes GM-CSF, however the potential for arming viruses is virtually limitless and provides many exciting opportunities to design multimodal therapeutic strategies with additive or synergistic anticancer effects (de Gruijl et al, 2015; Hermiston & Kuhn, 2002). Encoding bispecific T-cell activators within oncolytic viruses provides a powerful means to activate tumour infiltrating lymphocytes to become cytotoxic and lyse antigen-positive target cells, providing a completely separate therapeutic modality from the effects of direct viral lysis. In this study we have shown that Bispecific T-Cell Activator-Targeted Cytotoxicity is Fully Antigen-Specific, can be Mediated by Both CD4 and CD8 T Cells (Brischwein et al, 2006) and can be incorporated into an oncolytic adenovirus and expressed only in cells that allow virus replication. In addition the current study shows, for the first time, that endogenous T cells within liquid cancer biopsies can be activated by bispecific T-cell activators and virus-encoded bispecific T-cell activators and can kill endogenous tumour cells without any additional stimulation or reversal of immune suppression. Importantly, this can happen even in the primary fluids that comprise the microenvironment of peritoneal ascites or pleural effusions, as surrogates for the immune suppressive microenvironment of solid tumours.

Arming oncolytic viruses to express bispecific T-cell activators combines two quite distinct therapeutic mechanisms, with the former providing lytic death of tumour cells that are permissive for virus infection, and the latter targeting T cell cytotoxicity via a specific, chosen, antigen. This provides considerable flexibility in the design of a therapeutic approach, perhaps using the bispecific T-cell activators to deliver cytotoxicity to tumour-associated cells that are relatively resistant to kill by the virus directly. For example, while we have exemplified the technology here using a bispecific T-cell activator that recognises a carcinoma-associated antigen (EpCAM), it is also possible to use the bispecific T-cell activator approach to target cytotoxicity to tumour-associated fibroblasts or other stromal cells. Indeed, even when the targets for bispecific T-cell activator-recognition are not restricted to expression in the tumour microenvironment, by linking bispecific T-cell activator production to virus replication allows expression of the bispecific T-cell activator to be spatially restricted to the tumour, minimising systemic toxicities. This is important, as bispecific T-cell activators administered intravenously show relatively short circulation kinetics (Klinger et al, 2012) and are often associated with considerable on-target off-tumour toxicities (Teachey et al, 2013).

The possibility to encode bispecific T-cell activators within oncolytic viruses has been previously explored using an oncolytic vaccinia virus with an Ephrin A2-targeting bispecific T-cell activator. This agent showed that the Ephrin bispecific T-cell activator could mediate activation of PBMCs and antigen-targeted killing of tumour cells both in vitro and in vivo. Intriguingly, although the bispecific T-cell activator could activate T cells it did not lead to T cell proliferation without the addition of exogenous IL-2, whereas the bispecific T-cell activator used in the current study led to extensive proliferation both of PBMC in vitro and of tumour-associated lymphocytes using the clinical biopsy samples ex vivo.

We believe that the differences observed may reflect the different bispecific T-cell activator design, the different oncolytic virus used or perhaps depend on the antigen density giving sufficient crosslinking of CD3 on the T cells.

One central aim of oncolytic virus therapy is to create an anticancer T cell response that recognises patient specific neoantigens as well as "public" tumour associated antigens. Lytic viruses may do this by stimulating improved antigen presentation by lysing tumour cells in the context of DAMPs alongside virus-related pathogen-associated molecular patterns (PAMPs). Immunohistochemical staining of resected colon tumours, following intravenous delivery of EnAd, suggest the virus promotes a strong influx of CD8+ T cells into tumour tissue (Garcia-Carbonero, 2017). However, while this is potentially a very powerful approach, adaptive T cell responses are ultimately dependent on the expression of MHC class I antigens by tumour cells, to allow targeted killing. Loss of MHC expression is a well documented immune evasion strategy for tumours (Garrido et al, 2016). It is noteworthy that both cytotoxic strategies that are immediately engaged by bispecific T-cell activator-armed oncolytic viruses operate independently of MHC class I by the tumour cells, and therefore can be employed to kill cancer cells even when tumour cells have lost MHC expression.

The present study thus demonstrates that encoding bispecific T-cell activators within EnAd provides a particularly promising strategy to achieve targeted expression in disseminated tumours, exploiting the known blood-stability and systemic bioavailability of the virus, which has now been studied in several early phase clinical trials. Notably, in a study where the virus is given intravenously a few days prior to resection of primary colon cancer, subsequent immunohistological assessment of tumour sections showed that the virus had reached to regions through the tumours and gave strong intranuclear hexon signals, indicating successful infection and virus replication selectively in tumour cells. This confirms preclinical data (Di et al, 2014; Illingworth, 2017) indicating that this virus is stable in 100% human blood and should be capable of tumourtargeted infection of disseminated and metastatic malignancies in human patients.

bispecific T-cell activators could be encoded by EnAd without any loss of oncolytic virulence (FIG. 51, panel B), reflecting the considerable transgene packaging capacity of the virus. The presence of the transgene will not affect the physicochemical properties of the virus particles, hence the modified viruses should exhibit exactly the same clinical pharmacokinetics as the parental agent, and should be capable of expressing the encoded bispecific T-cell activator selectively within tumours throughout the body. This provides an exciting and potentially very effective new approach to systemically targeted cancer immunotherapy that should now be prioritised for clinical assessment.

Example 28

Figure 58:
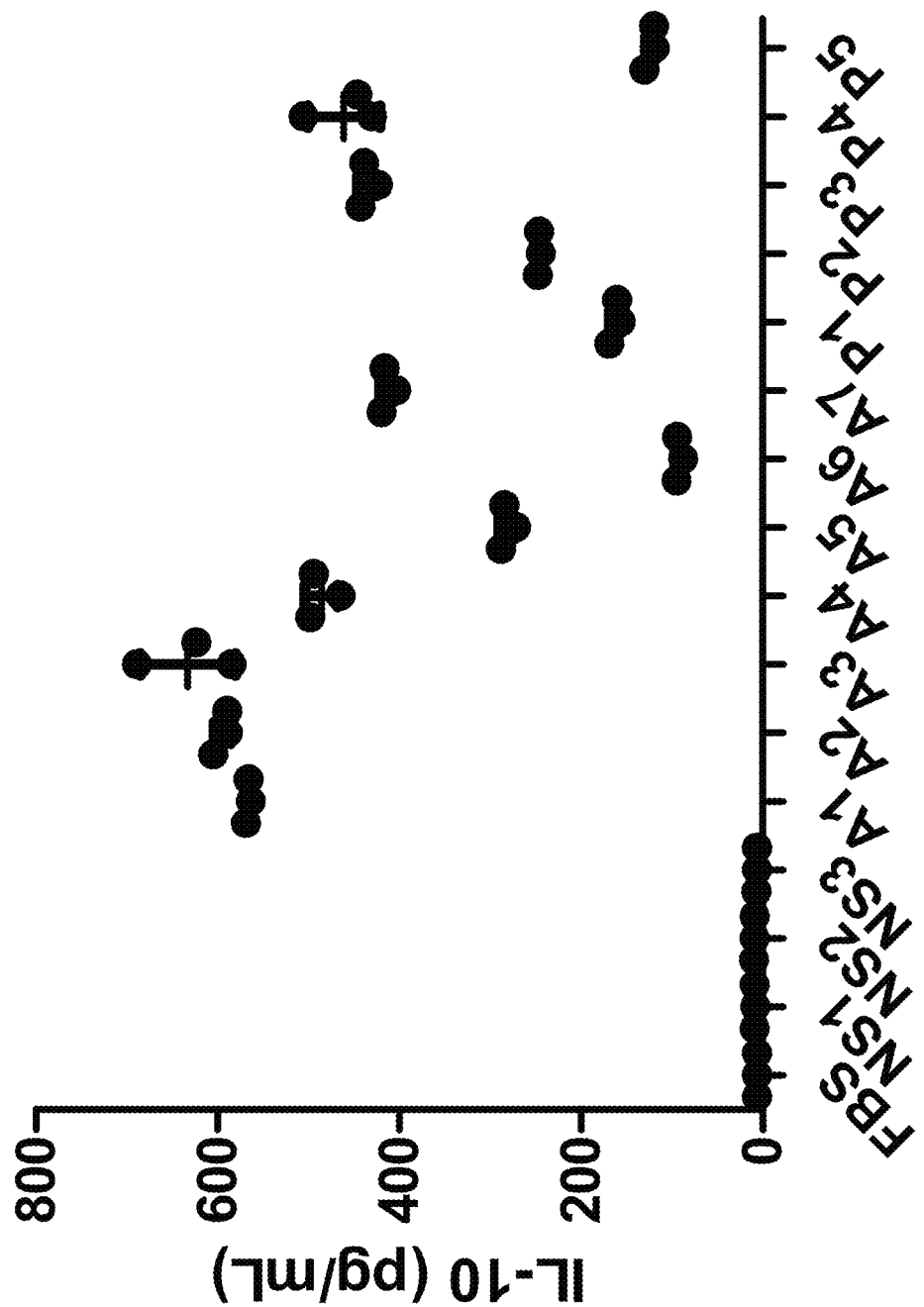
FIG. 58 shows quantity of IL-10 measured in normal serum (NS) or patient malignant exudate fluids (A: peritoneal ascites, P: pleural effusions) using Human IL-10 ELISA MAX kit (Biolegend, 430604).

Immunosuppression of Human T-Cell Activation and Target Cell Cytotoxicity by Patient Malignant Exudate Fluids Malignant exudates represent an environment of potential immune tolerance with suppressed immune responses commonly observed in patients with late-stage metastatic cancer. The quantity of IL-10, considered to be an anti-inflammatory cytokine, was measured in normal serum or patient malignant exudate fluids (A, peritoneal ascites; P, pleural effusion) using Human IL-10 ELISA MAX kit (Biolegend, 430604). IL-10 levels in the exudates (88.1-633.4 µg/mL) were far in excess of those measured in normal serum (7.2-10 µg/mL). See FIG. 58.

Figure 59:
FIG. 59 shows CD3/28 bead-mediated PBMC T-cell activation (based on CD 69/CD25 levels) in patient fluids vs normal serum measured by flow cytometry. A: patient exudate fluid, P: pleural fluid.

The ability of CD3/CD28 beads (Gibco, 11161D) to activate PBMC T-cells in the presence of normal serum, ascites or pleural fluid was investigated. Human PBMC T-cells (100,000 cells per well in 96 well plate) were treated with CD3/CD28 beads (following manufacturers instructions) in normal serum or patient exudate fluid (50%). T-cells were left untreated in each fluid as negative control. After 24 hours of culture, cells were harvested and the expression levels of CD69 and CD25 on CD3+ T-cells were then analysed by antibody staining and flow cytometry represented as percentage of dual positive (CD69+CD25+ cells) (FIG. 59). In normal serum the anti-CD3/CD28 beads gave approximately 60% of T cells dual positive for both CD25 and CD69, whereas the presence of ascites fluid attenuated T cell activation in 6/12 fluids.

Figure 60:
FIG. 60 shows CD3/28 bead-mediated PBMC T-cell degranulation (based on CD107a expression) in patient fluids. A: ascites, P: pleural fluid.
Figure 61:
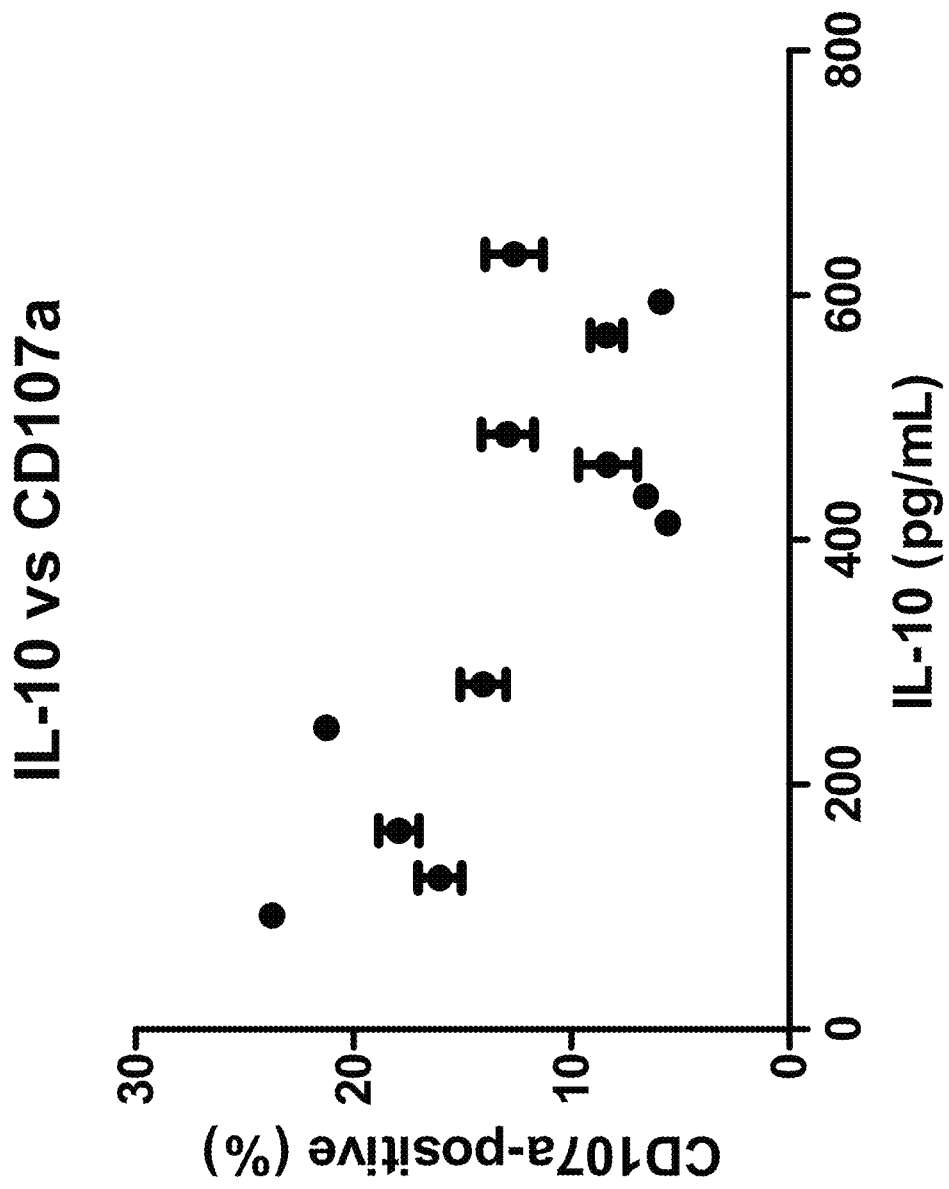
FIG. 61 shows the correlation between IL-10 levels in patient fluids and CD3/CD28 bead-mediated T-cell degranulation.

In a similar experiment, 100,000 T-cells were treated with CD3/CD28 beads in the presence of normal serum, ascites or pleural fluid (50%). Anti-CD107a or isotype control antibody were added directly to culture medium. After 1 hour, monensin was added (BD Golgistop, BD Biosciences) according to manufacturers instructions. After 5 further hours, cells were harvested and analysed by flow cytometry to determine degranulation (FIG. 60). In normal serum the anti-CD3/CD28 beads gave approximately 22.5% of T cells degranulated, whereas the presence of ascites fluid attenuated T cell activation in 10/12 fluids. The level of degranulation was significantly correlative (Pearson co-efficient, r=−0.7645; p=0.0038) with quantity of IL-10 in each fluid (FIG. 61).

Figure 62:
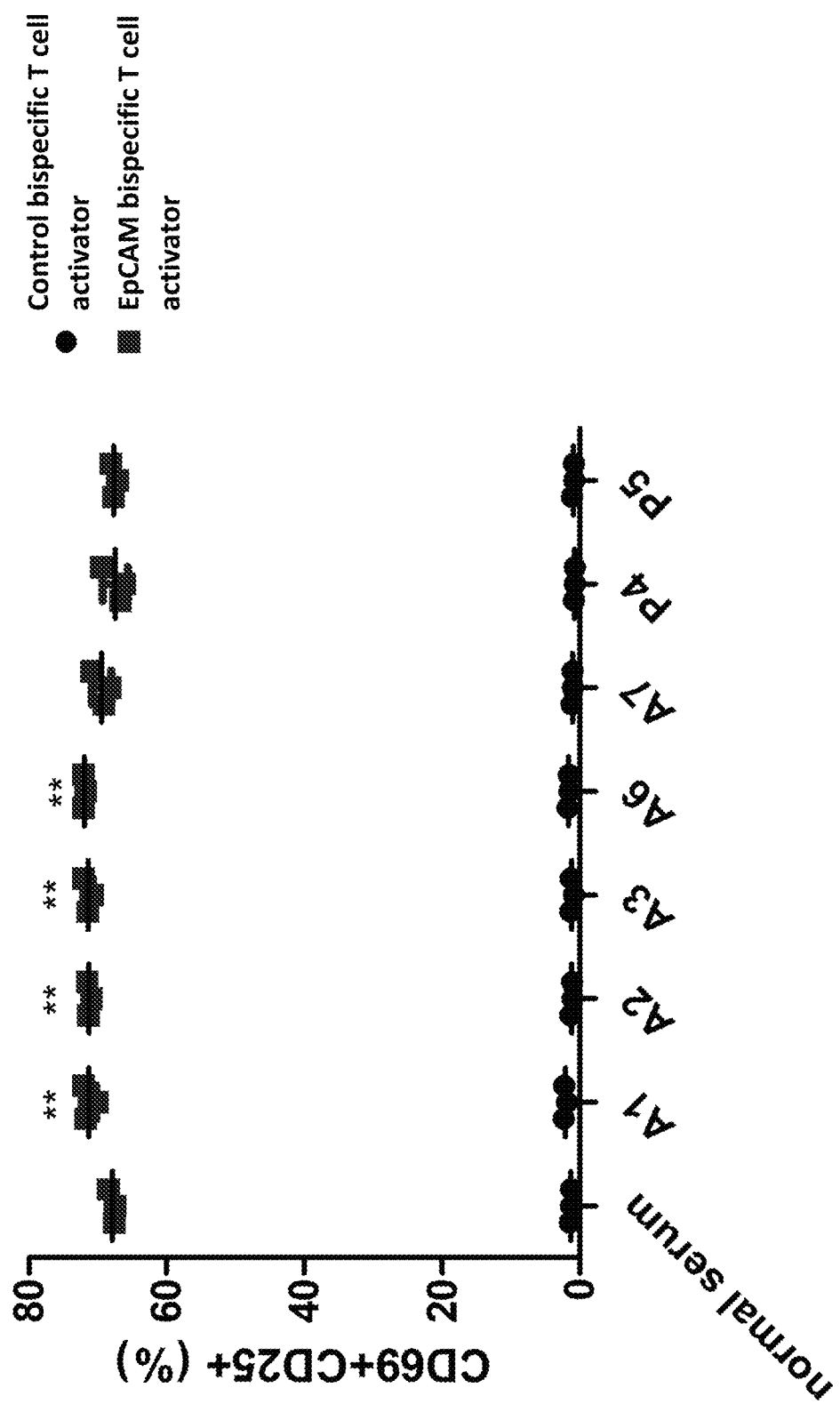
FIG. 62 shows EpCAM bispecific T-cell activator bead-mediated PBMC T-cell activation (based on CD69/CD25 expression) in patient fluids. A: ascites, P: pleural fluid.

In a similar experiment, 75,000 T-cells were co-cultured with 15,000 SKOV3 and EpCAM in the presence of normal serum, ascites or pleural fluid (50%). T-cells were treated with control bispecific T-cell activator in each fluid as negative control. After 24 hours of culture, cells were harvested and the expression levels of CD69 and CD25 on CD3+ T-cells were then analysed by antibody staining and flow cytometry represented as percentage of dual positive (CD69+CD25+ cells) (FIG. 62). In normal serum the EpCAM bispecific T-cell activator gave approximately 67.6% of T cells dual positive for both CD25 and CD69, whereas the presence of ascites fluid attenuated T cell activation in 0/12 fluids, and slightly induced activation in 4/10 fluids.

Figure 63:
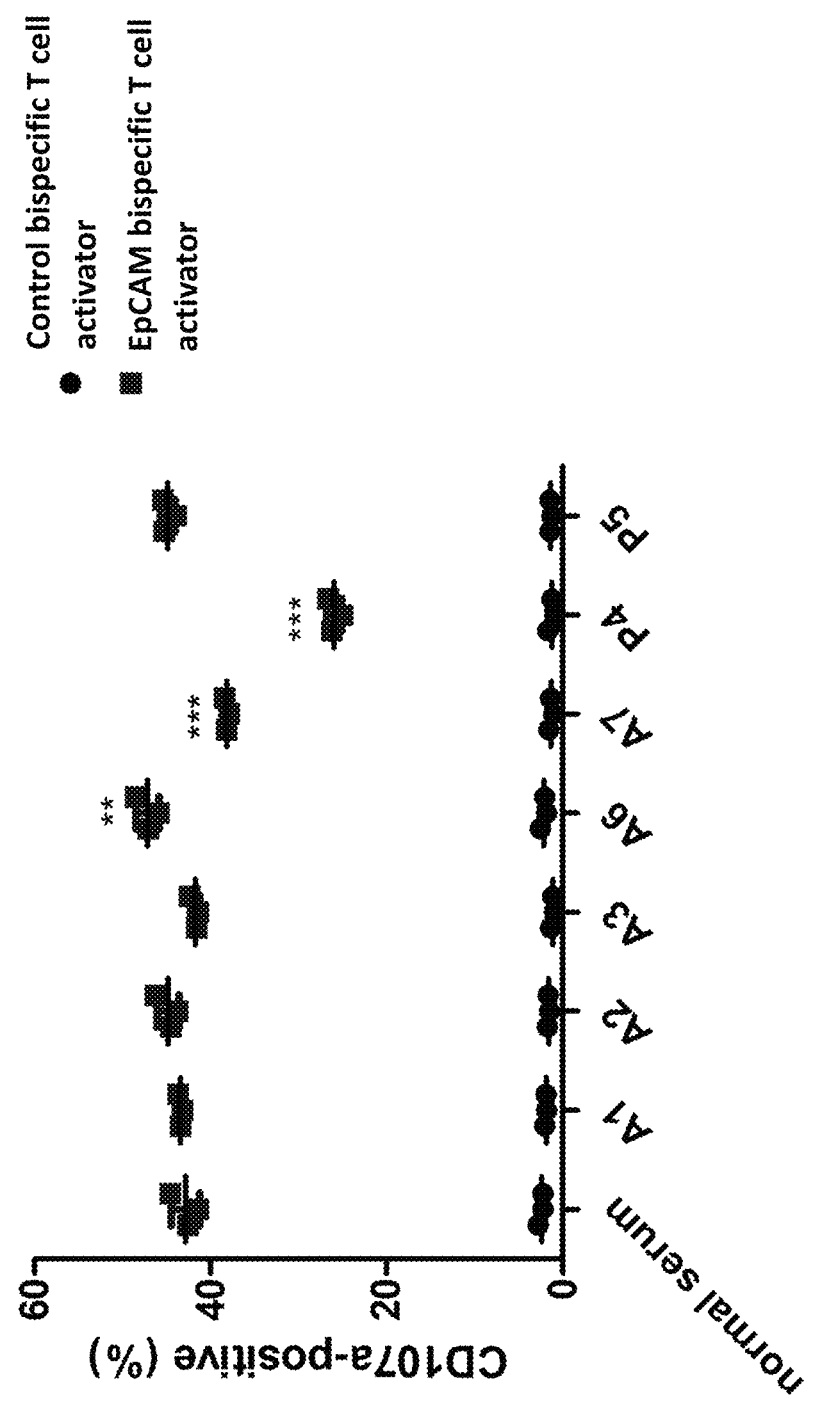
FIG. 63 shows EpCAM bispecific T-cell activator bead-mediated PBMC T-cell degranulation (based on CD107a expression) in patient fluids. A: ascites, P: pleural fluid.

In a similar experiment, 75,000 T-cells were co-cultured with 15,000 SKOV3 and EpCAM in the presence of normal serum, ascites or pleural fluid (50%). T-cells were treated with control bispecific T-cell activator in each fluid as negative control. Anti-CD107a or isotype control antibody were added directly to culture medium. After 1 hour, monensin was added (BD Golgistop, BD Biosciences) according to manufacturers instructions. After 5 further hours, cells were harvested and analysed by flow cytometry to determine degranulation (FIG. 63). In normal serum the EpCAM bispecific T-cell activator beads gave approximately 41.4% of T cells degranulated, whereas the presence of ascites fluid attenuated T cell activation in 2/12 fluids.

Figure 64:
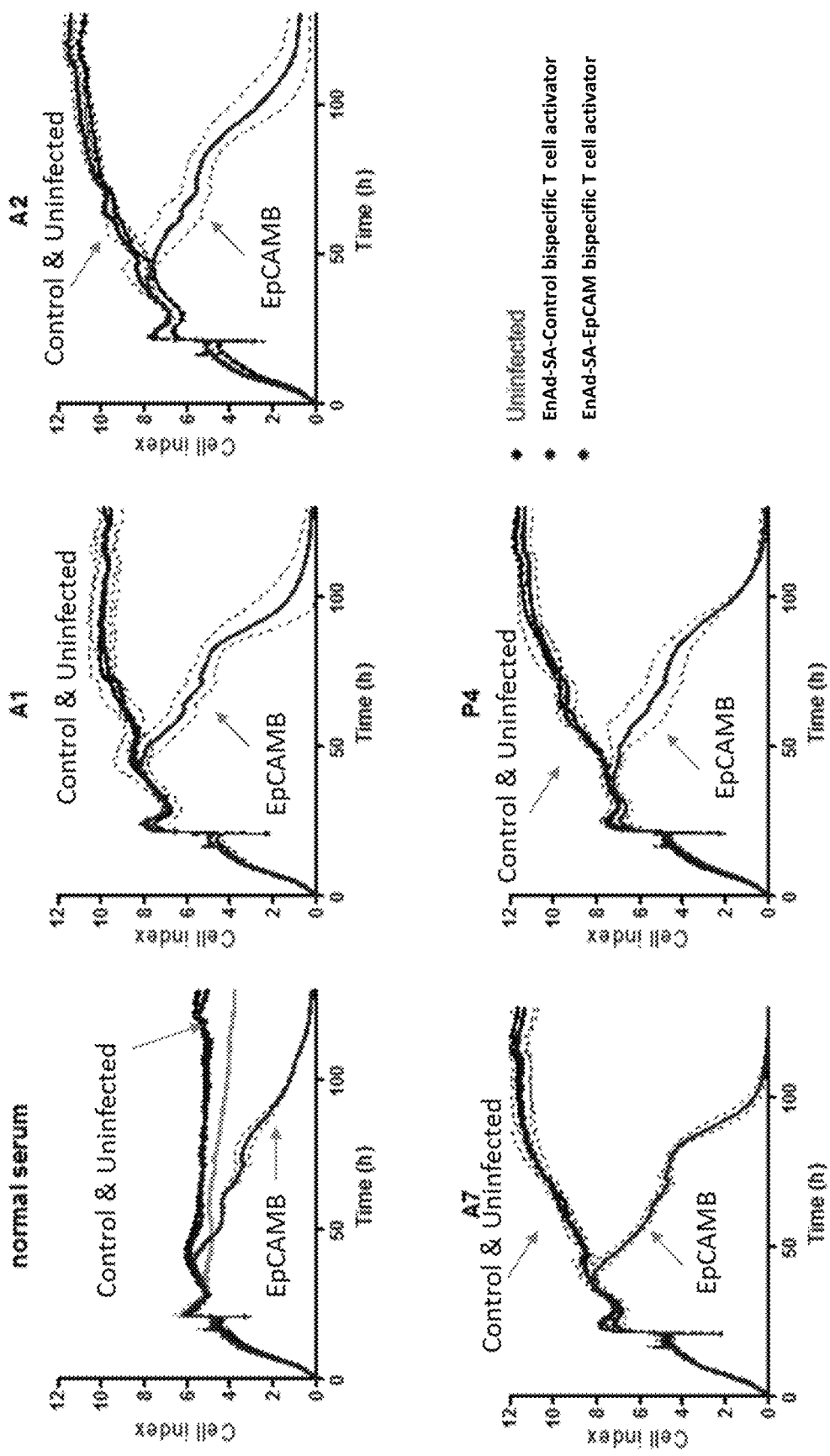
FIG. 64 shows EpCAM bispecific T-cell activator bead-mediated cytotoxicity of SKOV3 in patient fluids. A: ascites, P: pleural fluids.

The ability of EnAd-SA-EpCAMbispecific T-cell activator and EnAd-SA-Controlbispecific T-cell activator to induce T cell-mediated target cell lysis in malignant exudate fluids was assessed using xCELLigence technology. SKOV cells were plated in 48-well E-plate at 1e4 cells/well respectively. Plates were incubated for 18 hrs, 37° C., 5% CO2, before cells were either infected with 100 virus particles per cell (ppc) or were left uninfected. After two hours, PBMC T-cells (5:1) in normal serum or patient exudate fluid (final, 50%) were added. xCELLigence was used to measure target cell cytotoxicity every 10 minutes (FIG. 64). The results suggest that bispecific T-cell activator-mediated SKOV3 lysis by T-cells is independent of fluid used.

Figure 65:
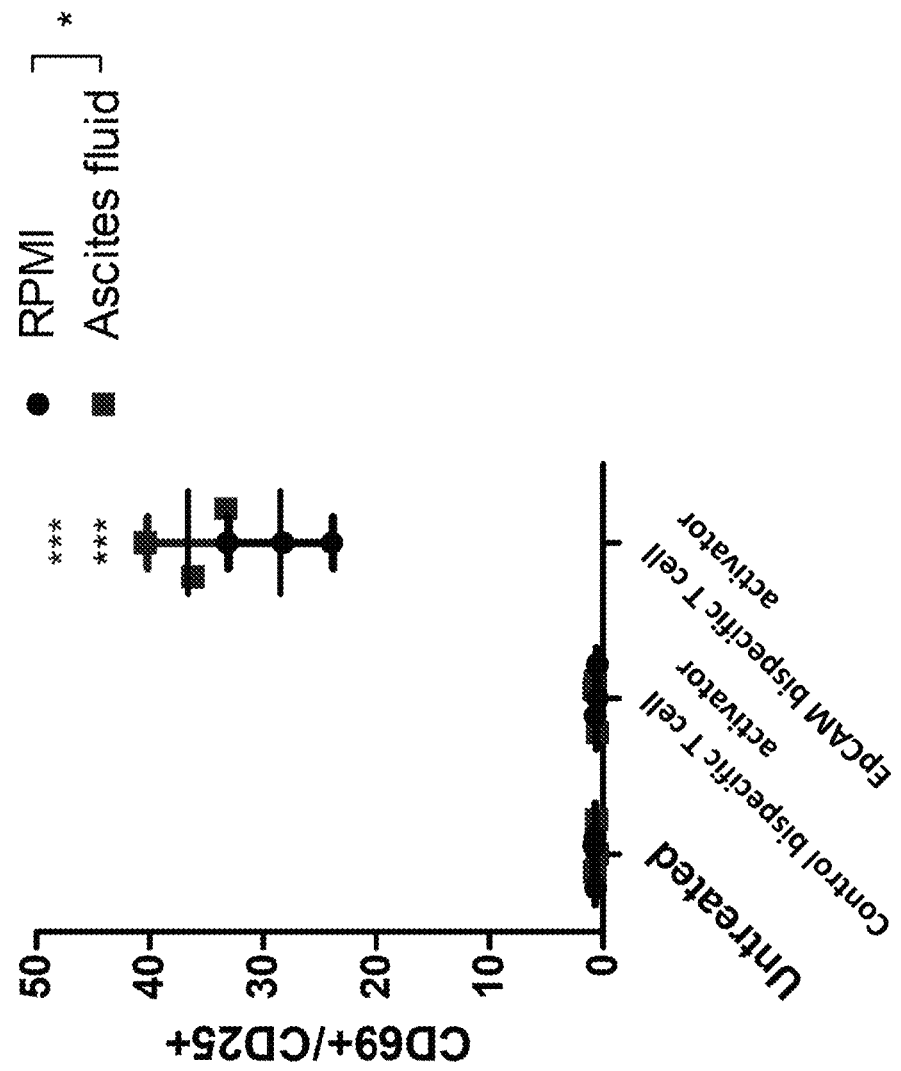
FIG. 65 shows EpCAM bispecific T-cell activator-mediated T-cell activation (based on CD25/CD69 expression) in RPMI media vs ascites fluid.

Unpurified ascites cells (therefore unchanged from when received) are seeded at 100,000 cells per well of a flat-bottom 96-well plate in RPMI media or ascites fluid. Cells were treated with EpCAM or control bispecific T-cell activator, with untreated wells serving as a negative control. After incubation at 37 C for 24 hours, cells were harvested, and the expression level of CD25 and CD69 on CD3 cells determined (FIG. 65). The results demonstrate that EpCAM bispecific T-cell activator resulted in significant increase in T-cell activation (CD69/CD25 dual positive) of tumour-associated lymphocytes, slightly increased by ascites fluid.

Figure 66:
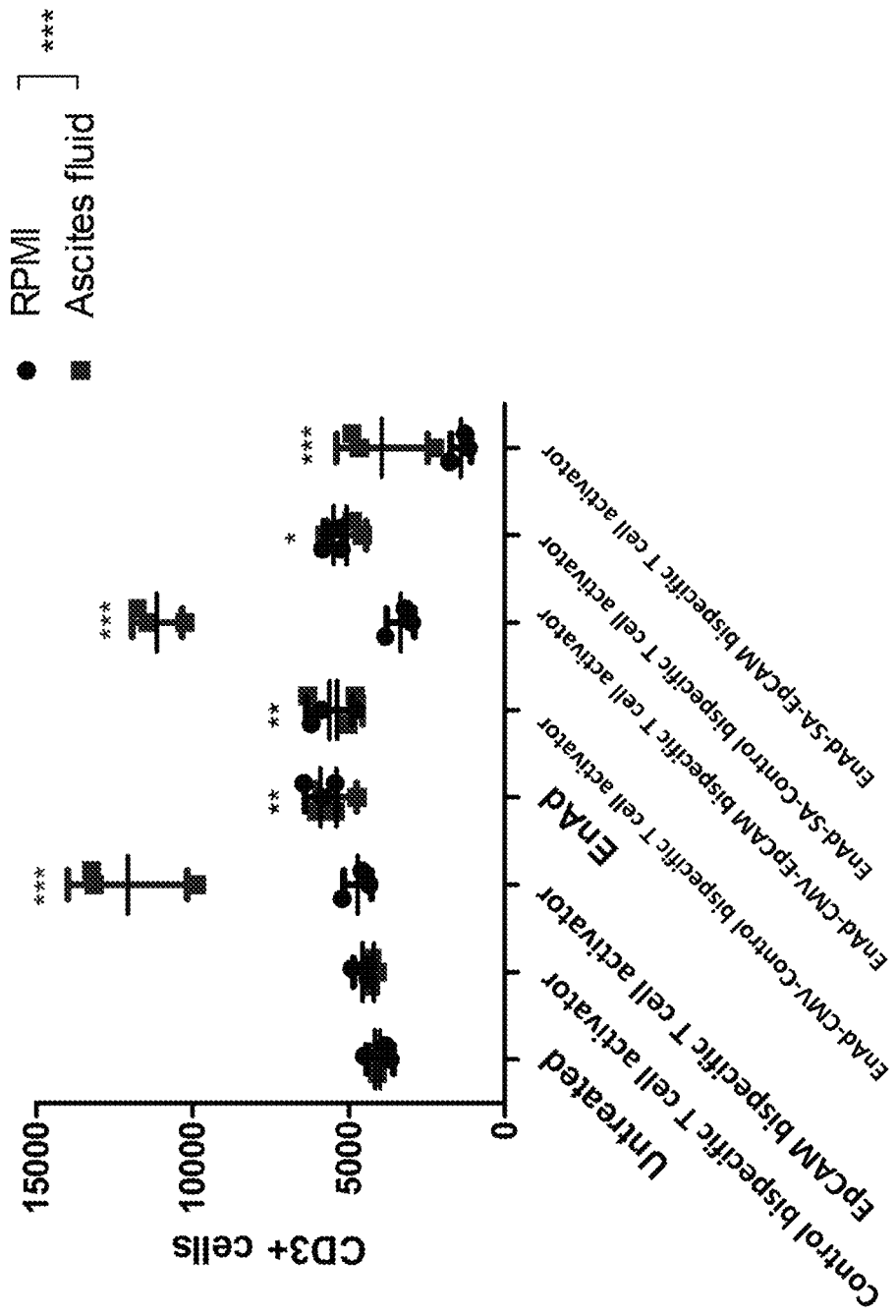
FIG. 66 shows the ability of EnAd-SA-EpCAMbispecific T-cell activator and EnAd-SA-Controlbispecific T-cell activators to induce T cell-mediated target cell lysis in RPMI media vs ascites fluid. ((A) number of CD3+. (B) CD25 expression of T-cells. (C) number of EpCAM+ cells determined by flow cytometry.

In a similar experiment, unpurified ascites cells (therefore unchanged from when received) are seeded at 100,000 cells per well of a flat-bottom 96-well plate in RPMI media or ascites fluid. Cells were treated with EpCAM, control bispecific T-cell activator or recombinant bispecific T-cell activator viruses (100 vp/cell), with untreated wells serving as a negative control (FIG. 66). After incubation at 37 C for 5 days, the total cell population was harvested, and the number of CD3+ cells (FIG. 66, panel A) and expression level of CD25 on CD3 cells determined (FIG. 66, panel B) and the number of endogenous EpCaM+cells determined by flow cytometry (FIG. 66, panel C). Total cell numbers per well were determined using precision counting beads. The results demonstrate that EpCAM bispecific T-cell activator and EnAd expressing EpCAM bispecific T-cell activator resulted in significant increase in T-cell activation (CD3 number, CD25) of tumour-associated lymphocytes and cytotoxicity of EpCAM+ cells in both RPMI media and ascites fluid.

Figure 67:
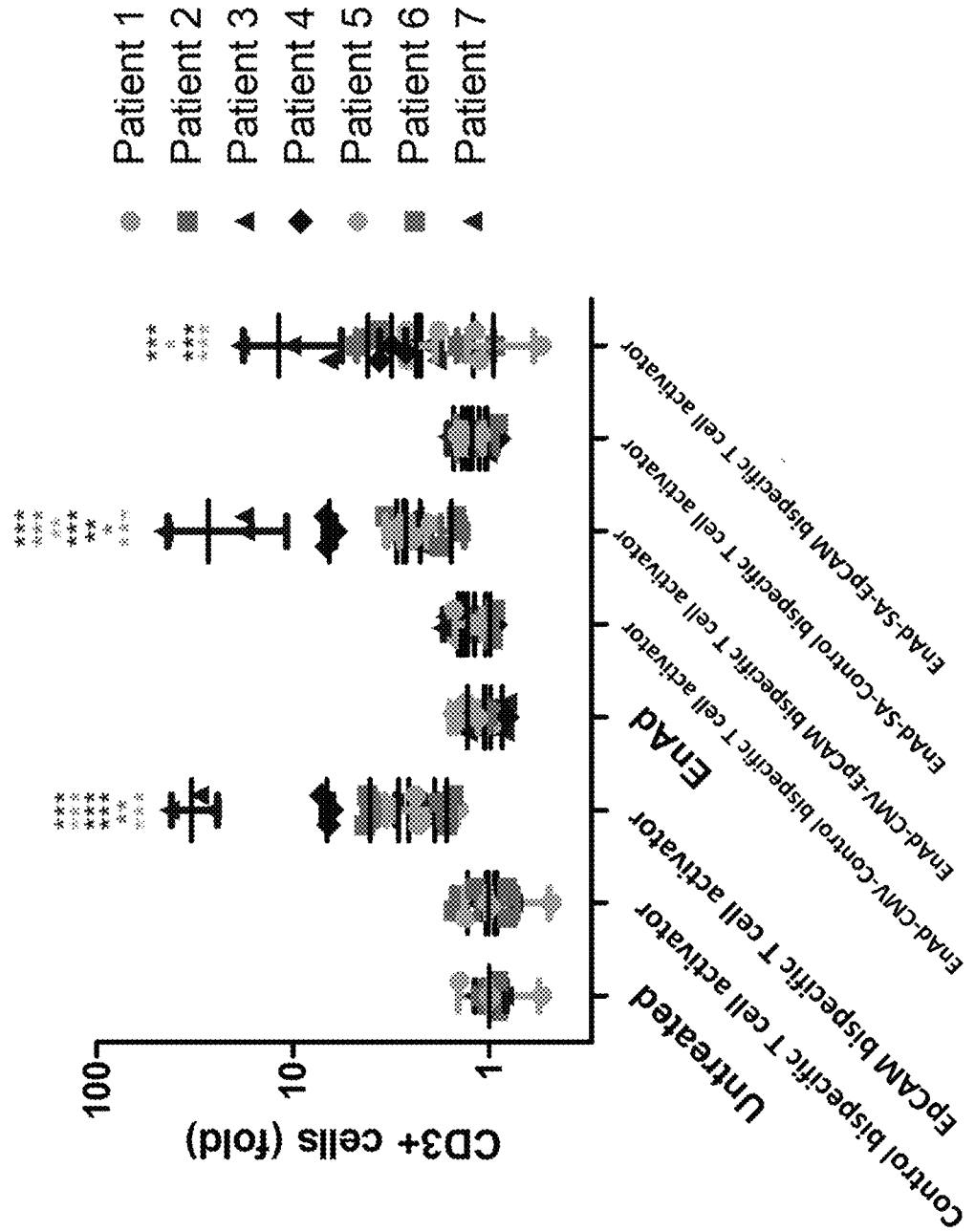
FIG. 67 shows the ability of EnAd-SA-EpCAMbispecific T-cell activators and EnAd-SA-Controlbispecific T-cell activators to induce T cell-mediated target cell lysis in ascites fluid (7 patient samples).
(A) number of CD3+. (B) CD25 expression of T-cells. (C) number of EpCAM+ cells determined by flow cytometry. See (A) for legend.

As an extension of the experiment above, six more patient exudate samples (for a total of 7) were treated identically in ascites fluid (FIG. 67) and number of CD3+(FIG. 67, panel A), CD25 expression of T-cells (FIG. 67, panel B) and number of EpCAM+ cells (FIG. 67, panel C) determined by flow cytometry. The results show that EpCAM bispecific T-cell activator and EnAd expressing EpCAM bispecific T-cell activator resulted in significant increase in T-cell activation (CD3 number, CD25) of tumour-associated lymphocytes and cytotoxicity of EpCAM+ cells reproducibly in a range of exudate biopsy samples.

Example 29

FAP Bispecific T-Cell Activator Mediate Activation of T-Cells and Killing of FAP+ Cells by Different Donor T-Cells In other experiments, methods described in Example 2 were used to further evaluate the T-cell activating properties of recombinant FAP bispecific T-cell activator protein tested in co-cultures of NHDF and T-cells, comparing to control bispecific T-cell activator and polyclonal T-cell activation using anti-CD3/CD28 Dynabeads.

Supernatants taken after 24 hours of culture were tested by ELISA for IFNγ (FIG. 68, panel A) and by cytokine bead array (LEGENDplex human T helper cytokine panel, BioLegend #74001) for a panel of cytokines (FIG. 68, panel B). The control bispecific T-cell activator induced no significant change in any cytokine, however the FAP-bispecific T-cell activator led to strong increases in gamma interferon, IL-2, TNFα, IL-17 and IL-10, consistent with different subsets of T-cells being stimulated, and production of IFNγ was far greater than that triggered by anti-CD3/CD28.

Stimulation with the FAP bispecific T-cell activator, but not control bispecific T-cell activator, in the presence of NHDF cells also induced rapid degranulation (within 6 hr) of T-cells, both CD4+ and CD8+ subsets, as determined by the externalisation of CD107a/LAMP1 on the T-cell surface (as assessed by flow cytometry), which is strongly correlative with their ability to kill target cells (FIG. 69, panels A&B). This induction of degranulation by the FAP bispecific T-cell activator translated to potent fibroblast lysis (FIG. 69, panel C), as measured by LDH release after 24 h co-culture with PBMC T-cells (EC 50 of ~2.5 ng/mL) with induced T-cell activation and cytotoxicity observed using 6/6 donor T-cells (FIG. 69, panel D). No cytotoxicity was induced by the control bispecific T-cell activator, consistent with T-cells remaining in an inactivated state.

Example 30

Figure 70:
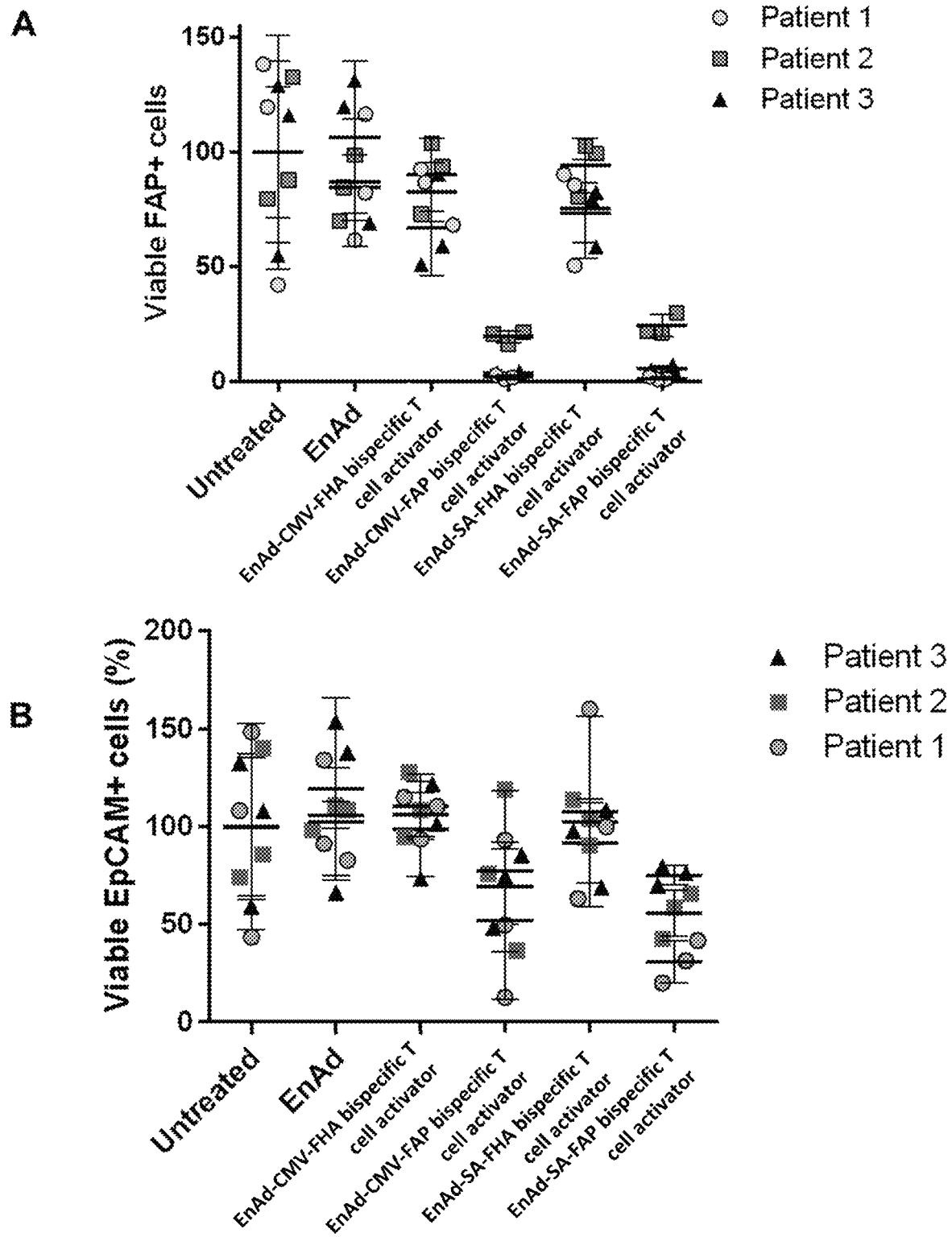
FIG. 70 EnAd expressing FAP Bispecific T-cell Activator selectively kills FAP+ fibroblasts and decreases TGFb in peritoneal ascites samples
(A,B) Number of of FAP+ fibroblasts (A) and EpCAM+ tumour cells (B) after 72 h culture with PBMC-derived T-cells and EnAd or recombinant viruses. Ascites cells were first isolated from three patients ascites and expanded ex vivo. Cell number was measured at 72 h post-infection by flow cytometry. (C) Induction of activation marker CD25 on PBMC-derived CD3 cells from (A) was measured at 72 h post-infection. (D) Levels of TGFb were measured by ELISA using supernatants harvested from (A).

Effect of FAP Bispecific T-Cell Activator and EnAd-FAP Bispecific T-Cell Activator Viruses on Cells in Primary Malignant Ascites Samples from Different Ancer Patients As a follow-on to studies described in Example 16, fresh primary malignant peritoneal ascites from further cancer patients were obtained for study of EnAd FAP bispecific T-cell activator virus activities. Three patient samples containing both EpCAM+ tumour cells and FAP fibroblasts were expanded ex vivo, and the mixed (adherent) cell populations were cultured with PBMC-derived T-cells and unmodified or bispecific T-cell activator expressing EnAd viruses. After 72 h, total cells were harvested and the number of FAP (FIG. 70, panel A) and EpCAM+ cells (FIG. 70, panel B) determined by flow cytometry. Additionally, the activation status of T-cells (by CD25 expression) was measured (FIG. 70, panel C). Infection with both EnAd-CMV-FAPbispecific T-cell activator and EnAd-SA-FAPbispecific T-cell activator induced T-cell activation and FAP cell depletion in all patient samples, with no significant change in levels of EpCAM+ tumour cells. Parental EnAd or the control viruses induced no observable T cell activation, with FAP cell numbers remaining similar to the uninfected control.

Importantly, this depletion in FAP+ fibroblasts consistently led to a strong reduction in levels of the immunosuppressive cytokine TGFβ detected in supernatants (FIG. 70, panel D).

Figure 71:
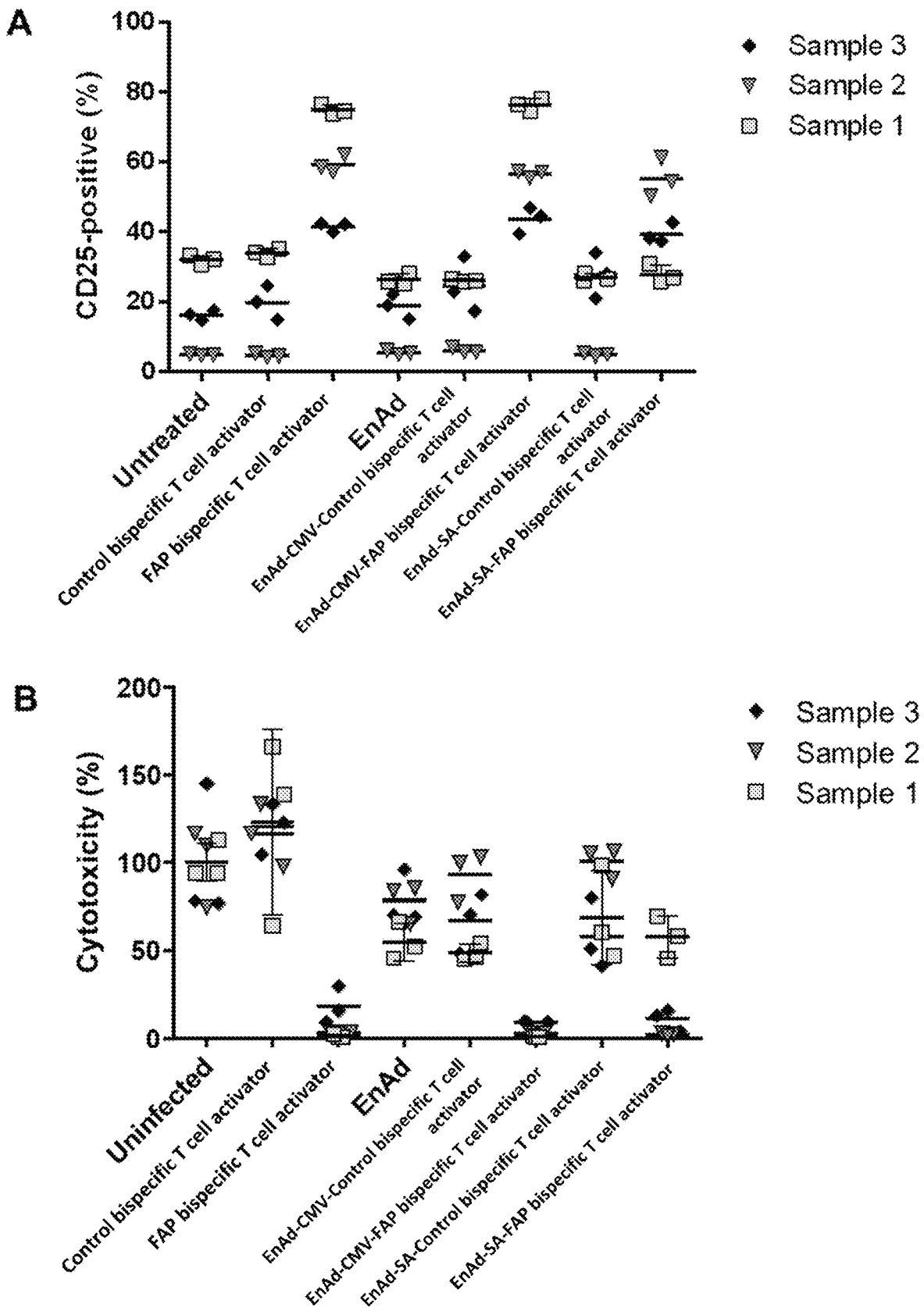
FIG. 71 shows the activation of endogenous tumor associated T-cells and associated killing of FAP+ cells in patient malignant ascites biopsy samples by FAP bispecific T-cell activator protein and EnAd-FAPbispecific T-cell activator viruses. (A) T cell activation measured by CD25 expression. (B) residual number of FAP+ cells measured by flow cytometry.

In a second series of experiments, total (and unpurified) cells from five patient biopsy samples were evaluated to assess the activity of endogenous tumour-associated T-cells in the samples. Cells were plated in 50% ascites fluid and treated with recombinant control or FAP bispecific T-cell activator proteins, or 100 vp/cell of EnAd or EnAd-bispecific T-cell activator viruses. After 5 days incubation, T-cell activation (by CD25 expression) and residual number of FAP cells was measured by flow cytometry (FIG. 71, panels A&B). In all 3 patient samples, recombinant FAP-bispecific T-cell activator and EnAd-CMV-FAP bispecific T-cell activator induced strong T-cell activation, with up to ~80% of patient-derived T-cells activated, which caused a marked depletion FAP fibroblasts. Interestingly, EnAd-SA-FAP-bispecific T-cell activator induced CD25 expression in 2/3 samples, with no observable activation or FAP cell depletion in patient 1. This is probably due to insufficient tumour cells being present for infection by the virus and production of bispecific T-cell activator protein (no EpCAM$^+$ tumour cells were detected in this sample by flow cytometry), consistent with the requirement for tumour cells for MLP (SA)-driven transgene expression (this likely also explains the lack of T-cell activation and FAP$^+$ cell depletion by EnAd-SA-FAP-bispecific T-cell activator virus with the patient ascites sample illustrated in FIGS. 42-44). Collectively, the data shows that EnAd expressing FAP-bispecific T-cell activator can, following infection of tumor cells, reproducibly lead to activation of tumour-associated T-cells to kill endogenous fibroblasts.

Figure 72:
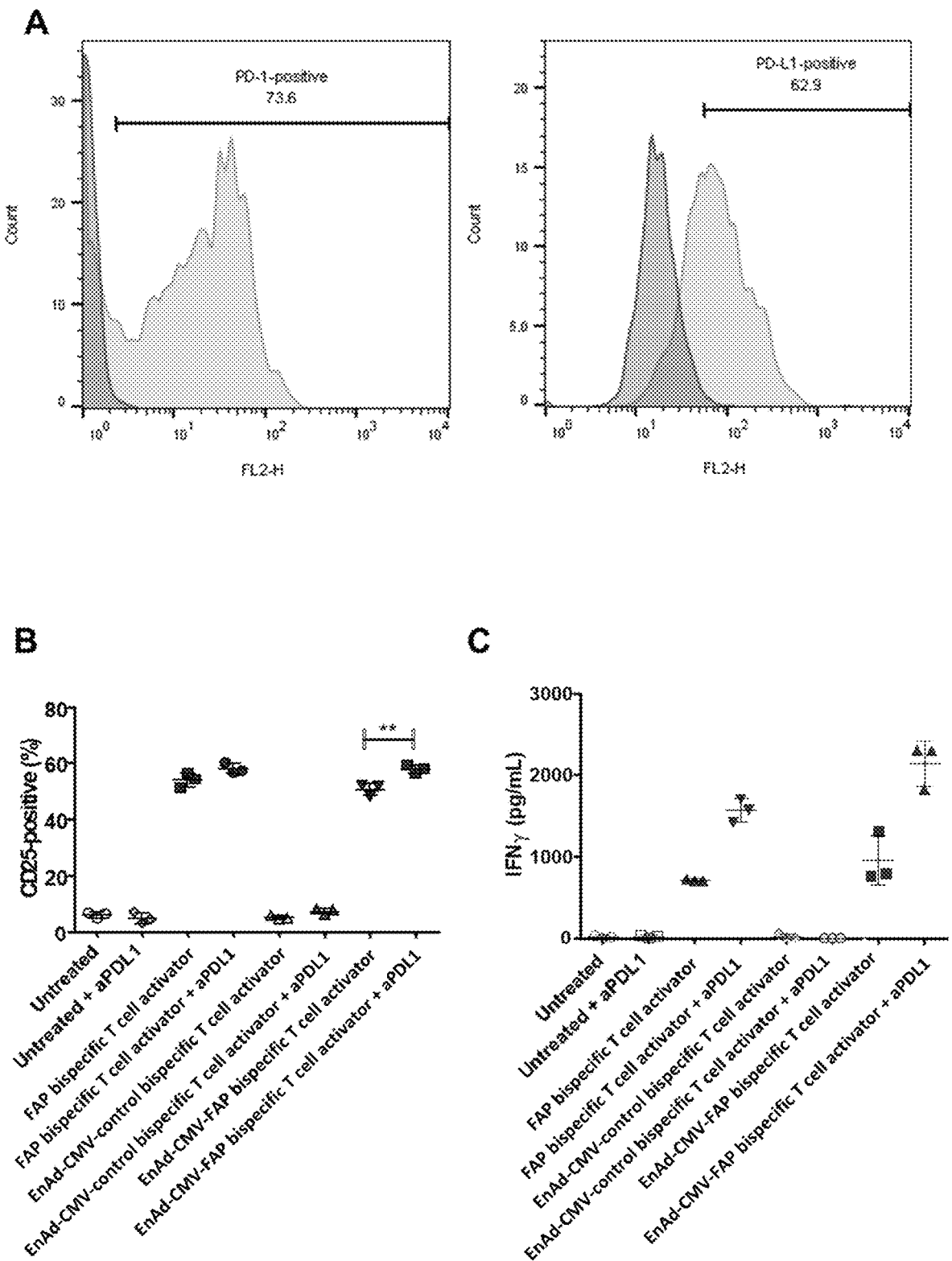
FIG. 72 Effect of PD-L1 blocking antibodies on Bispecific T-cell Activator-mediated T cell activation in patient sample
(A) Expression of PD1 by endogenous T cells and PD-L1 on FAP+ cells following their initial isolation from peritoneal ascites was assessed by flow cytometry. (B) Unpurified total cells from peritoneal ascites were incubated in 50% fluid from the same exudate in the presence of free bispecific T-cell activators, EnAd or recombinant virus, with or without anti-PD-L1 blocking antibody. After 2 days, the total cell population was harvested, and the number of CD25+ T-cells was quantified by flow cytometry. (C) Quantity of interferon gamma in culture supernatants from (B, D) measured by ELISA. (D) The number of residual FAP+ cells in (B) was measured using flow cytometry.

Another experiment investigated whether FAP-bispecific T-cell activator activity could be improved by blocking the PD-1 checkpoint, using a patient biopsy sample in which T-cells were 73.6% PD-1 positive and FAP$^+$ cells were 62.9% PDL1-positive (FIG. 72, panel A). Co-cultures similar to those described above were set up in the presence or absence of a purified blocking mouse IgG2b antibody to human PDL1 (BioLegend, clone 29E.2A3) at a final concentration of 2.5 µg/mL. After 2 days of culture, total cells were harvested and residual FAP+ cells and T-cell activation was measured. The inclusion of the blocking anti-PDL1 antibody led to a modest increase in CD25 induction (FIG. 72, panel B) and a two-fold higher IFNγ production (FIG. 72, panel C), without altering the depletion of FAP+ cells (FIG. 72, panel D) with near complete lysis by day 2 in either setting.

Figure 73:
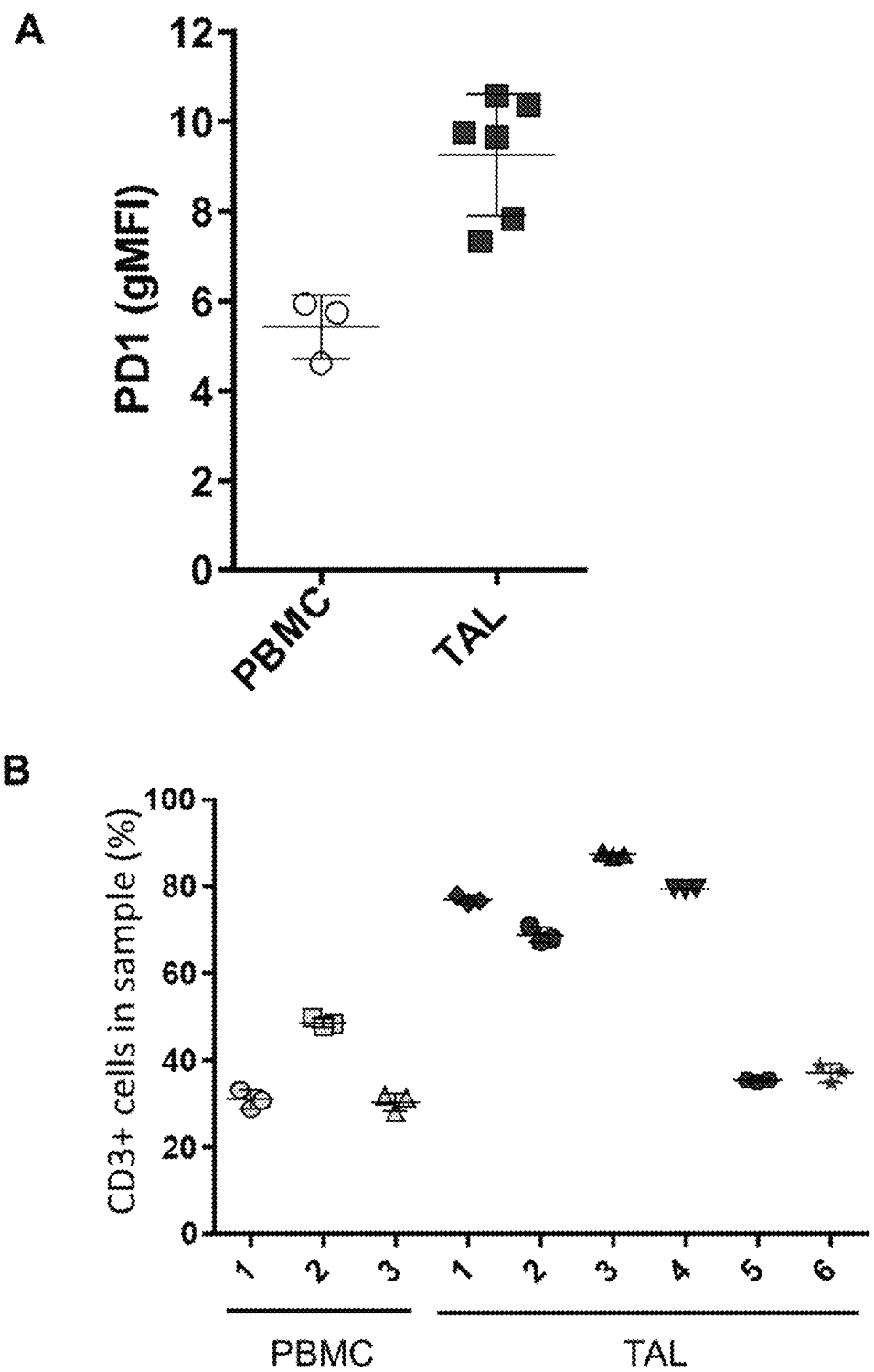
FIG. 73 EnAd expressing Bispecific T-cell Activators activate and redirect T-cells from patient biopsy samples to lyse NHDF fibroblasts
(A) The expression of PD-1 by endogenous T cells following isolation from healthy donors or malignant exudate cancer biopsy samples. PD-1 expression was measured by flow cytometry. (B) The proportion of CD3+ cells within the unpurified cell population of PBMC and cancer biopsy samples as measured by flow cytometry. (C) Levels of interferon gamma measured by ELISA in culture supernatants harvested from (B) at 120 h post-treatment. (D) Viability of NHDF fibroblasts were monitored in real time over 130 h by xCELLigence cytotoxicity assay in co-culture with PBMC or total cancer biopsy cells (1:5) and bispecific T-cell activator-containing supernatant.

Tumour-associated lymphocytes (TALs) isolated from ovarian cancer patient ascites are reported to have enriched expression of PD-1 and impaired effector functions—including cytotoxicity and IFNg production. Consistent with this, PD-1 expression was 2-fold higher on CD3$^+$ cells from six cancer patient ascites biopsies than on those in peripheral blood mononuclear cells (PBMCs) from three healthy donors (FIG. 73, panel A). To evaluate the functionality of the T-cells within these cancer biopsy samples, NHDF cells and unpurified PBMC or ascites cells (the % CD3+ cells for each of the samples is shown in FIG. 73, panel B) were co-cultured with control or FAP bispecific T-cell activator-containing supernatants, and supernatants were harvested 5 days later and tested for IFNγ by ELISA (FIG. 73, panel C). No IFNγ was induced by the control bispecific T-cell activator. Three of the ascites cell samples produced IFNγ at a similar level to that of the PB MC samples, while the other three had an attenuated response to the FAP bispecific T-cell activator. We next investigate the ability of these T-cells to induce bispecific T-cell activator-mediated lysis of the NHDF cells. NHDF were plated, and PBMC or ascites cells added along with bispecific T-cell activator-containing supernatants and the viability of cells in the culture monitored in real-time using the xCELLigence cytotoxicity assay system. Despite the variability in IFNγ production, all ascites samples induced full cytotoxicity of NHDF cells when added with the FAP bispecific T-cell activator, with an overall similar rate of bispecific T-cell activator-mediated NHDF lysis to that seen with when effected by PBMCs (FIG. 73, panel D).

To investigate whether the FAP bispecific T-cell activator can mediate T-cell activation in the presence patient malignant exudate samples (all at 50%), PBMC T-cells were activated with control or FAP bispecific T-cell activators in the presence of NHDF cells, or activated with anti-CD3/ CD28 Dynabeads, either in 50% normal human serum (NS) or different (cell-free) malignant exudate samples. Whereas in normal serum 74% of T-cells were activated (dual-positive for both CD25 and CD69) at 24 h following stimulation with the anti-CD3/CD28 beads, 3/5 tested ascites fluid significantly attenuated T-cell activation compared to the response in NS (FIG. 74, panel A). However, when PBMCs were cultured with NHDF and stimulated with the FAP bispecific T-cell activator, there was no observable suppression of T-cell activation in the presence of any of the exudate fluids (FIG. 74, panel B), demonstrating that the FAP bispecific T-cell activator can overcome immunosuppressive mechanisms to activate T-cells.

Example 31

EnAd-FAPbispecific T-Cell Activator-Mediated Oncolysis and T Cell Stimulation Polarise CD11b+ TAMs in Patient Ascites to a More Activated Phenotype To investigate whether the production of Th1 cytokines, including IFNγ, TNFα and IL-2, by FAP bispecific T-cell activator-mediated activation of T-cells, and the subsequent elimination of FAP fibroblasts (and associated reduction in TGFβ1 was associated other shifts in the tumour microenvironment from immunosuppressive and pro-oncogenic towards anti-tumour activity, the effect on tumour-associated macrophages (TAMs) in an unseparated ascites cell sample was evaluated. Total unpurified patient ascites cells were plated in 50% ascites fluid and treated with free control or FAP bispecific T-cell activator or infected with EnAd-SA-control bispecific T-cell activator or EnAd-SA-FAPbispecific T-cell activator virus (at 100 vp/cell). In parallel, some cells were treated in with IFNγ to induce an activated CD11b myeloid cell phenotype. After 3 days incubation, the activation status of T-cells was first measured; CD25+ cells measured by flow cytometry and IFNγ secretion by ELISA.

Figure 75:
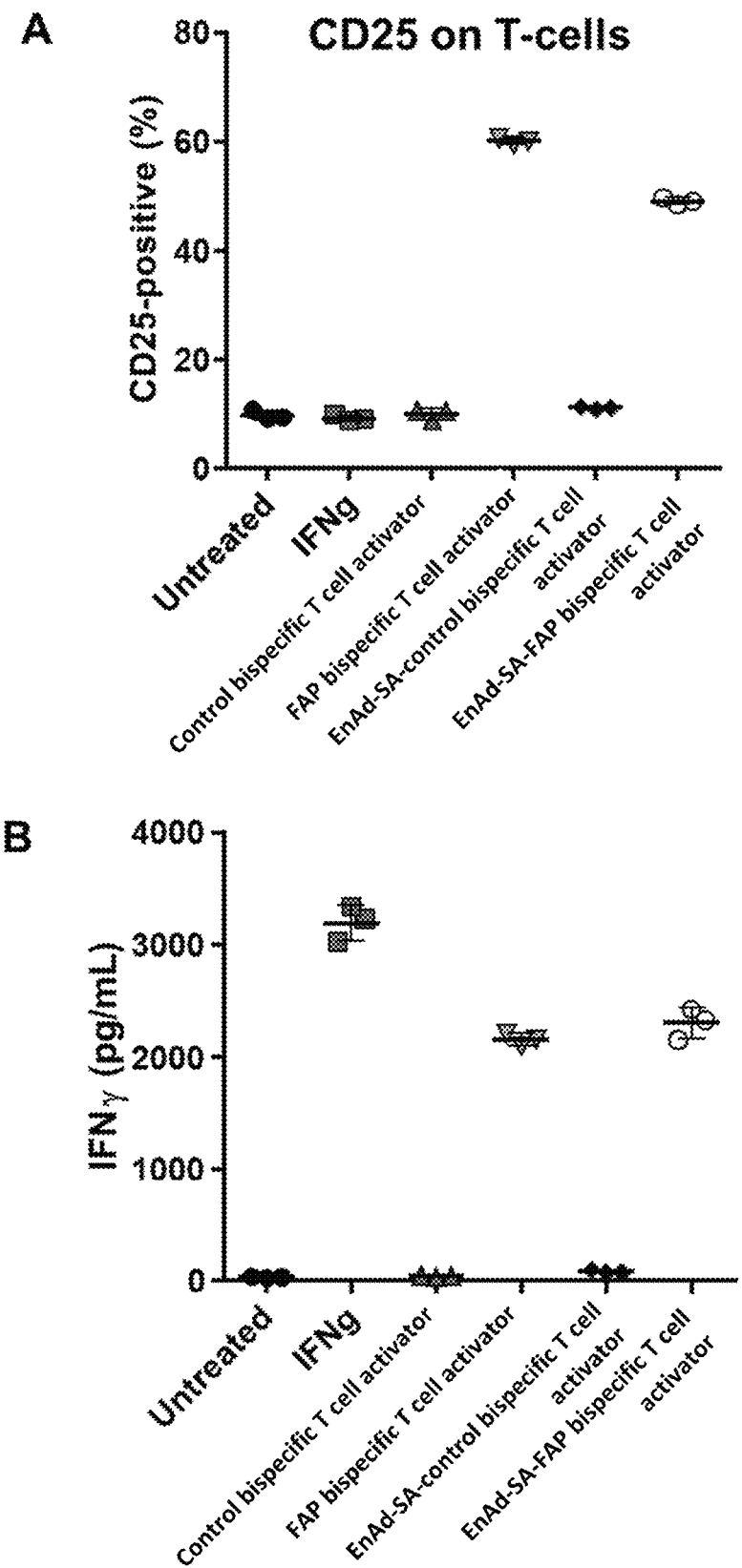
FIG. 75 FAP Bispecific T-cell activator expressing EnAd polarises CD11b$^+$ macrophage in patient ascites to a more inflammatory phenotype
(A) Unpurified total cells from ascites sample were incubated in 50% ascites fluid in the presence of free bispecific T-cell activators or bispecific T-cell activator expressing virus. Interferon gamma treatment was used as a positive control. After 3 days, the total cell population was harvested and the induction of activation marker CD25 on CD3$^+$ cells was measured by flow cytometry. (B) Levels of interferon gamma in culture supernatants from (A) were measured by ELISA. (C) At 3 days, the expression levels of CD68, CD86, CD206 and CD163 on CD11b+ cells from (A) were measured by flow cytometry. Representative flow cytometry spectra from triplicates is shown alongside the complete data set.

Treatment with FAP bispecific T-cell activator and EnAd-SA-FAPbispecific T-cell activator led to approximately 60% of CD3+ T-cells becoming CD25+(FIG. 75, panel A) and large quantities of IFNγ in culture supernatants (FIG. 75, panel B). No increase above background by the control bispecific T-cell activator or control virus was observed for CD25 expression or IFNγ. To evaluate TAM polarisation, the expression levels of CD64 and CD86 (M1 or 'activated' macrophage markers) and CD206 and CD163 (M2 or TAM markers) were measured on CD11b+ cells by flow cytometry (FIG. 75, panel C). Treatment with free FAP bispecific T-cell activator or EnAd expressing FAP bispecific T-cell activator induce a more activated phenotype, manifested by significant increases in CD64 expression, and strong decreases CD206 and CD163—similar to that observed when IFNγ was spiked into the cultures.

While treatment with free FAP bispecific T-cell activator or control virus induced no clear change in CD86 above background in this experiment, the EnAd expressing FAP bispecific T-cell activator induced a large increase in CD86 expression, indicating that EnAd virus infection and FAP bispecific T-cell activator activity may synergize to activate primary myeloid cells within a suppressive tumour microenvironment such as the malignant ascetic fluid samples tested here. In this study, IFNγ treatment induced a modest decrease in CD86, indicating that the strong increase in CD86 observed by EnAd-SA-FAPbispecific T-cell activator may be via an IFNγ-independent mechanism.

Example 32

EnAd-FAPbispecific T-Cell Activator Activates Tumour-Infiltrating Lymphocytes and Induces Cytotoxicity in Solid Prostate Tumour Biopsies Ex Vivo Tissue slice cultures provide one of the most realistic preclinical models of diverse tissues, organs and tumours. To evaluate the activity of the FAP bispecific T-cell activator expressing viruses in this highly clinically-relevant setting, several paired punch biopsies of malignant and benign prostate tissue from resected human prostates were studies. At initial screening, prostate tissue was reproducibly shown to have circular rings of EpCAM+ tumour cells (FIG. 76, panel A) interspersed between large regions of stroma containing scattered CD8 T-cells (FIG. 76, panel B). FAP staining was found on fibroblasts adjacent to tumour regions (FIG. 76, panel C).

Cores were sliced by a vibratome to 300 μm thickness and slice cultures established in the presence of virus (1.5e9 vp/slice), or left uninfected. After 7 days, slices were fixed, paraffin-embedded, sectioned and T-cell activation status was assessed by immunohistochemistry (IHC) by staining for CD25 expression (FIG. 76, panel D). Only samples receiving EnAd-CMV-FAPbispecific T-cell activator or EnAd-SA-FAPbispecific T-cell activator showed activation of tumour-infiltrating T-cells, manifest by strong CD25 staining. Neither untreated or control virus-treated had detectable CD25-positive cells. Supernatants from these slice cultures taken at 4 and 7 days post-infection were tested for IFNγ and IL-2 by ELISA, with increases in IFNγ detected from malignant, but not benign, prostate slice cultures infected with either FAP bispecific T-cell activator virus (FIG. 76, panel E) and IL-2 detected in cultures with EnAd-SA-FAPbispecific T-cell activator virus (FIG. 76, panel F). The EnAd-SA-FAPbispecific T-cell activator induced higher quantities of IFNγ, which were detectable earlier, than the CMV-driven FAPbispecific T-cell activator virus.

Example 33—EnAd Viruses Expressing EpCAM or FAP Bispecific T-Cell Activators

Five viruses (NG-611, NG-612, NG-613, NG-614, NG-617) were generated that encode a single Bispecific T-cell activators (Table 8).

TABLE 8

| Virus ID | Transgene Cassette |
|---|---|
| NG-611 (SEQ ID NO: 96) | SSA[1]-EpCambispecific T-cell activators[2]-His[3]-PA[4] |
| NG-612 (SEQ ID NO: 97) | SSA[1]-FAPbispecific T-cell activators[5]-His[3]-PA[4] |
| NG-613 (SEQ ID NO: 98) | SA[6]-FAPbispecific T-cell activators[5]-His[3]-PA[4] |
| NG-614 (SEQ ID NO: 99) | SA[6]-FAPbispecific T-cell activators[7]-His[3]-PA[4] |
| NG-617 (SEQ ID NO: 100) | SSA[1]-FAPbispecific T-cell activators[5]-PA[4] |

[1]SEQ ID NO. 55;
[2]SEQ ID NO. 83;
[3]SEQ ID NO. 84;
[4]SEQ ID NO. 65;
[5]SEQ ID NO. 85;
[6]SEQ ID NO. 86;
[7]SEQ ID NO. 87;

In each transgene cassette, the cDNA encoding the bispecific T-cell activator was flanked at the 5' end with either a short splice acceptor sequence (SSA, SEQUENCE ID NO: 55) or a longer splice acceptor sequence (SA, SEQUENCE ID NO: 86). At the 3' end of the bispecific T-cell activator, a SV40 late poly(A) sequence (PA, SEQUENCE ID NO: 65) was encoded preceded by either a Histidine tag (HIS, SEQ ID NO. 41) or no tag. In viruses NG-611, NG-612, NG-613 and NG-617 the anti-CD3 portion of the bispecific T-cell activator molecule used a single chain variant of the mouse anti-human CD3 E monoclonal antibody OKT3.

Virus Production

The plasmid pEnAd2.4 was used to generate the plasmids pNG-611, pNG-612, pNG-613, pNG-614 and pNG-617 by direct insertion of synthesised transgene cassettes (SEQ ID NOs: 88-92, respectively). The pNG-611 transgene cassette encodes for an EpCam targeting bispecific T-cell activator (SEQ ID NO. 93), the pNG-612, pNG-613 and pNG-617 transgene cassettes encode a FAP targeting bispecific T-cell activator of SEQ ID NO. 94 and the pNG-614 transgene cassette encodes a FAP targeting bispecific T-cell activator of SEQ ID NO. 95. Schematics of the transgene cassettes are shown in FIG. 77, panels A to C. Construction of plasmid DNA was confirmed by restriction analysis and DNA sequencing.

The plasmids, pNG-611, pNG-612, pNG-613, pNG-614 and pNG-617, were linearised by restriction digest with the enzyme AscI to produce the virus genomes. The viruses were amplified and purified according to methods given below.

Digested DNA was purified by phenol/chloroform extraction and precipitated for 16 hrs, −20° C. in 300 μl >95% molecular biology grade ethanol and 10 μl 3M Sodium Acetate. The precipitated DNA was pelleted by centrifuging at 14000 rpm, 5 mins and was washed in 5000 70% ethanol, before centrifuging again, 14000 rpm, 5 mins. The clean DNA pellet was air dried, resuspended in 5000 OptiMEM containing 15111 lipofectamine transfection reagent and incubated for 30 mins, RT. The transfection mixture was then added drop wise to a T-25 flask containing 293 cells grown to 70% confluency. After incubation of the cells with the transfection mix for 2 hrs at 37° C., 5% $CO_2$ 4 mls of cell media (DMEM high glucose with glutamine supplemented with 2% FBS) was added to the cells and the flasks was incubated 37° C., 5% $CO_2$.

The transfected 293 cells were monitored every 24 hrs and were supplemented with additional media every 48-72 hrs. The production of virus was monitored by observation of a significant cytopathic effect (CPE) in the cell monolayer. Once extensive CPE was observed the virus was harvested from 293 cells by three freeze-thaw cycles. The harvested viruses were used to re-infect 293 cells in order to amplify the virus stocks. Viable virus production during amplification was confirmed by observation of significant CPE in the cell monolayer. Once CPE was observed the virus was harvested from 293 cells by three freeze-thaw cycles. The amplified stocks of viruses were used for further amplification before the viruses were purified by double caesium chloride banding to produce purified virus stocks.

Virus Activity Assessed by qPCR

A549 cells, either infected for 72 hrs with 1ppc NG-611, NG-612, NG-617, enadenotucirev or left uninfected, were used for quantification of viral DNA by qPCR. Cell supernatants were collected and clarified by centrifuging for 5 mins, 1200 rpm. DNA was extracted from 451A of supernatant using the Qiagen DNeasy kit, according to the manufacturer's protocol. A standard curve using enadenotucirev virus particles (2.5e10-2.5e5vp) was also prepared and extracted using the DNeasy kit Each extracted sample or standard was analysed by qPCR using a virus gene specific primer-probe set to the early gene E3.

Quantification of the number of detected virus genomes per cell demonstrated that NG-611, NG-612, and NG-617 showed significant genome replication in A549 cell lines (FIG. 77, panel D). This was similar for all viruses tested including the parental virus enadenotucirev, indicating that inclusion of the bispecific T-cell activator transgene does not impact virus replicative activity. No virus genomes could be detected in uninfected cells (data not shown).

T Cell Activation and Degranulation Mediated by Bispecific T-Cell Activator Expressing Viruses. Carcinoma Cell Infection A549 cells were seeded into 24 well plates at a density of 2.5e5 cells/well. Plates were incubated for 4 hrs, 37° C., 5% $CO_2$, before cells were either infected with 1ppc of NG-611, NG-612, enadenotucirev or were left uninfected. At 24, 48 or 72 hrs post-infection supernatants were harvested from the cells, clarified by centrifuging for 5 mins, 1200 rpm and snap frozen.

T Cell Assay

FAP expressing lung fibroblast cell lines MRC-5, or EpCam expressing ovarian carcinoma cells, SKOV3 were seeded into 48 well plates at densities of 5.7e4 cells/well and 1.2e5 cells/well, respectively. Plates were incubated for 4 hrs, 37° C., 5% $CO_2$, before media was replaced with 150 µL/well of thawed supernatant harvested from the A549 plates. Purified CD3 T cells isolated form human PBMC donors were then also added to the plates to give a ratio of T cells to MRC-5 or SKOV3 of 2 to 1. The co-cultures were incubated for 16 hrs, 37° C., 5% $CO_2$ before cellular supernatants were collected for ELISA analysis and T cells harvested for flow cytometry analysis. Culture media containing non-adherent cells was removed from co-culture wells and centrifuged (300×g). The supernatant was carefully removed, diluted 1 in 2 with PBS 5% BSA and stored for ELISA analysis. The adherent cell monolayers were washed once with PBS and then detached using trypsin. The trypsin was inactivated using 10% FBS RPMI media and the cells were added to the cell pellets that had been collected from the culture supernatants. The cells were centrifuged (300×g), the supernatant discarded and the cell pellet washed in 2004 of PBS. The cells were centrifuged again then resuspended in 504 of PBS containing Live/Dead Aqua (Life tech) for 15 minutes at RT. The cells were washed once in FACs buffer before staining with panels of directly conjugated antibodies: anti-CD3 conjugated to AF700; anti-CD25 conjugated to BV421; anti-HLA-DR conjugated to PE/CYS; anti-CD40L conjugated to BV605; anti-CD69 conjugated to PE and anti-CD107a conjugated to FITC. A sample of cells from each co-culture condition was also stained with relevant isotype control antibodies. All staining was carried out in FACs buffer in a total volume of 504/well for 15 minutes, 4° C. Cells were then washed twice with FACs buffer (2004) before resuspension in 2004 of FACs buffer and analysis by Flow cytometry (Attune).

Upregulation of T Cell Activation Markers

Flow cytometry analysis of T cell activation was assessed by expression of the T cell activation markers CD25, CD69, HLA-DR and CD 40L or the T cell degranulation marker, CD107a on live, single cells. These data showed that when co-cultured with EpCam+ SKOV3 cells the number of T cells expressing CD25, CD69, HLA-DR, CD40L or cell surface CD107a was significantly increased when NG-611 supernatants were added to the cells compared to NG-612, enadenotucirev or untreated control supernatants (FIG. 78). For all these markers little T cell activation was stimulated by supernatants from A549 cells infected for 24 hrs however, by 48 hrs post-infection, supernatants stimulated significant T cell activation across all markers. This was also the case at 72 hrs post-infection.

When co-cultured with FAP MRC-5 cells the number of T cells expressing CD25, CD69, HLA-DR, CD40L or cell surface CD107a was significantly increased when NG-612 supernatants were added to the cells compared to NG-611, enadenotucirev or untreated control supernatants (FIG. 79). Some T cell activation could also be observed with the NG-611 virus, which was likely due to low but detectable expression of EpCam (~5%) on the MRC-5 cell lines engaging the EpCam bispecific T-cell activator expressed by the NG-611 virus (FIG. 80). For all these markers, little T cell activation was stimulated by supernatants from A549 cells infected for 24 hrs however, by 48 hrs post-infection, supernatants stimulated significant T cell activation across all markers. CD25 and CD69 markers were also upregulated following incubation with supernatants harvested 72 hrs post-infection, however, activation markers, HLA-DR, CD40L and CD107a were detected at lower levels with supernatants harvested 72 hrs post-infection than 48 hrs post-infection. This could be due to high levels of bispecific T-cell activator present at this later stage of infection leading to rapid and potent T cell activation that means the effector functions need to measured at timepoints earlier than 16 hrs post-incubation with the supernatants.

For detection of IFNγ expression, co-culture supernatants were diluted into 5% BSA/PBS assay buffer (in a range of 1:10 to 1:1000) and ELISA was carried out using the Human IFN gamma Quantikine ELISA kit (R&D systems) according to the manufacturer's protocol. The concentration of secreted IFNγ was determined by interpolating from the standard curve. Expression of IFNγ could only be detected in the supernatants of co-cultures using NG-611 on SKOV3 cells FIG. 81, panel A) or NG-611, NG-612 on MRC-5 cells (FIG. 81, panel B).

Example 34: Immune Activation and Anti-Tumour Efficacy of Bispecific T-Cell Activator Expressing Viruses In Vivo NSG mice humanised CD34+ haematopoietic stem cells (from Jackson Labs) were implanted with HCT116 tumour cells subcutaneously on both flanks at 18 weeks post engraftment. Once tumours reached 80-400 $mm^3$ mice were grouped such that each treatment arm had an equivalent distribution of tumour volumes, 7 mice per group. Mice were injected intratumourally with either saline, enadenotucirev or NG-611 at $5 \times 10^9$ particles per injection, 2 injections per tumour. Tumours on both flanks were treated. Tumour volume was measured 3-4 times per week and demonstrated that NG-611 treatment resulted in a significant anti-tumour response out to 20 days post-dosing compared to enadenotucirev or untreated controls (FIG. 82, panel a). After the 20 days post-dosing one tumour from 4 mice in each group was processed for flow cytometry while remaining tumours were frozen on dry ice.

Flow Cytometry

Tumour samples were mechanically disaggregated immediately following resection in a small volume of RPMI media. Disaggregated tumours were then passed through a 70 µm cell strainer and centrifuged at 300 g for 10 minutes. Cell pellets were resuspended in 1004 of PBS containing Live/Dead Aqua (Life tech) for 15 minutes on ice. The cells were washed once in FACs buffer (5% BSA PBS) before staining with a panel of directly conjugated antibodies: anti-CD8 (RPA-T8, AF700); anti-CD4 (RPA-T4, PE); anti-CD45 (2D1, APC-Fire 750); anti-CD3 (OKT3, PerCP-Cy5.5); anti-CD25 (M-A251, PE-Dazzle 594); anti-CD69 (FN50, APC); anti-HLA-DR (L243, BV605); anti-CD107a (H4A3, FITC). A pool of tumour cell suspensions was also stained with relevant isotype control antibodies. All staining was carried out in FACs buffer in a total volume of 504/well for 20 minutes at 4° C. Cells were washed three times with FACs buffer (2004) before resuspension in 2004 of FACs buffer and analysis by Flow cytometry (Attune). FACs analysis demonstrated that the ratio of CD8 to CD4 T cells in the tumour was significantly increased in NG-611 treated tumours compared to enadenotucirev treated or untreated controls (FIG. 82, panel b).

Example 35—EnAd Viruses Co-Expressing FAP Bispecific T-Cell Activators and Immune-Modulatory Cytokines and Chemokines Three viruses (NG-615, NG-640 and NG-641) were generated that encoded a FAP bispecific T-cell activator and immunomodulatory proteins (Table 9).

Virus Activity Assessed by qPCR and Transgene ELISA Carcinoma Cell Infection

A549 cells either infected for 72 hrs with 1ppc NG-615, enadenotucirev or left uninfected were used for quantification of viral DNA by qPCR and analysis of transgene expression by ELISA. Cell supernatants were collected and clarified by centrifuging for 5 mins, 1200 rpm. 451A of supernatant was used for DNA analysis and the remaining supernatant was used for ELISA.

qPCR

DNA was extracted from the supernatant sample using the Qiagen DNeasy kit, according to the manufacturer's protocol. A standard curve using enadenotucirev virus particles (2.5e10-2.5e5vp) was also prepared and extracted using the DNeasy kit. Each extracted sample or standard was analysed by qPCR using a virus gene specific primer-probe set to the early gene E3. Quantification of the number of detected virus genomes per cell demonstrated that NG-615 showed significant genome replication in A549 cell lines at a level similar to that of the parental virus enadenotucirev (FIG. 84). These data indicated that inclusion of the bispecific T-cell activator and three immunomodulatory transgenes does not significantly impact virus replicative activity. No virus genomes could be detected in uninfected cells.

TABLE 9

| Virus ID | Transgene Cassette |
| --- | --- |
| NG-615 (SEQ ID NO: 101) | SSA[1]-FAPbispecific T-cell activator[2]-E2A[3]-Flt3L[4]-P2A[5]-MIP1α[6]-T2A[7]-IFNα[8]-PA[9] |
| NG-640 (SEQ ID NO: 102) | SSA[1]-FAPbispecific T-cell activator[2]-P2A[5]-CXCL10[10]-T2A[7]-CXCL9[11]-PA[6] |
| NG-641 (SEQ ID NO: 103) | SSA[1]-FAPbispecific T-cell activator[5]-P2A[5]-CXCL10[10]-T2A[7]-CXCL9[11]-E2A[3]-IFNα[8]-PA[6] |
| NG-615 (SEQ ID NO: 298) | SA[12]-FAPbispecific T-cell activator[2]-E2A[3]-Flt3L[4]-P2A[5]-MIP1α[6]-T2A[7]-IFNα[8]-PA[9] |

[1]SEQ ID NO. 55;
[2]SEQ ID NO. 87;
[3]SEQ ID NO. 63;
[4]SEQ ID NO. 105;
[5]SEQ ID NO. 61;
[6]SEQ ID NO. 107;
[7]SEQ ID NO. 64;
[8]SEQ ID NO. 109;
[9]SEQ ID NO. 65;
[10]SEQ ID NO. 110;
[11]SEQ ID NO. 111;
[12]SEQ ID NO. 86

Virus Production

The plasmid pEnAd2.4 was used to generate the plasmids pNG-615, pNG-616, pNG-640 and pNG-641 by direct insertion of synthesised transgene cassettes (SEQ ID NOs: 112-114, respectively). NG-615 and NG-616 contain four transgenes encoding for a FAP-targeting bispecific T-cell activator (SEQ ID NO: 94), Flt3L (SEQ ID NO. 115), MIP1a SEQ ID NO. 116) and IFNα (SEQ ID NO. 117). NG-640 and NG-641 encode for a FAP targeting bispecific T-cell activator (SEQ ID NO. 94), CXCL9 (SEQ ID NO. 118) and CXCL10 (SEQ ID NO. 119), NG-641 also contains a fourth transgene encoding IFNα (SEQ ID NO. 117) Schematics of the transgene cassettes are shown in FIG. 83, panels A to C. Construction of plasmid DNA was confirmed by restriction analysis and DNA sequencing.

The plasmids, pNG-615, pNG-616, pNG-640 and pNG-641, were linearised by restriction digest with the enzyme AscI to produce the virus genomes. The viruses were amplified and purified according to methods detailed in Example 33.

ELISA

IFNα ELISA was carried out using the Verikine Human IFN alpha Kit (Pbl assay science), MIP1a ELISA was carried out using the Human CCL3 Quantikine ELISA kit (R & D systems) and Flt3L ELISA was carried out using the Flt3L human ELISA kit (Abcam). All assays were carried out according to the manufacturers' protocol.

The concentrations of secreted IFNα, MIPα or FLt3L were determined by interpolating from the standard curves. IFNα, MIP1a and Flt3 L expression could be detected in the cellular supernatant of NG-615 but not enadenotucirev or untreated control cells (FIG. 85).

T Cell Activation and Degranulation Mediated by Bispecific T-Cell Activator Expressing Viruses. Carcinoma Cell Infection A549 cells were seeded into 24 well plates at a density of 2.5e5 cells/well. Plates were incubated for 4 hrs, 37° C., 5% CO$_2$, before cells were either infected with 1ppc of NG-612, NG-615, enadenotucirev or were left uninfected. At 24, 48 or 72 hrs post-infection supernatants were harvested from the cells, clarified by centrifuging for 5 mins, 1200 rpm and snap frozen.

T Cell Assay

FAP expressing lung fibroblast cell lines MRC-5 were seeded into 48 well plates at a density of 5.7e4 cells/well. Plates were incubated for 4 hrs, 37° C., 5% $CO_2$, before media was replaced with 150 μL/well of thawed supernatant harvested from the A549 plates. Purified CD3 T cells isolated form human PB MC donors were then also added to the plates to give a ratio of T cells to MRC-5 of 2 to 1. The co-cultures were incubated for 16 hrs, 37° C., 5% $CO_2$ before cellular supernatants were collected for ELISA analysis and T cells harvested for flow cytometry analysis according to the methods detailed in Example 29.

Upregulation of T Cell Activation Markers

Flow cytometry analysis of T cell activation was assessed by expression of the T cell activation markers CD25, CD69, HLA-DR and CD40L or the T cell degranulation marker, CD107a on live, CD3+, single cells. These data showed that when co-cultured with FAP MRC-5 cells the number of T cells expressing CD25, CD69, HLA-DR, CD40L or CD107a was significantly increased when NG-615 or 612 supernantants were added to the cells compared to enadenotucirev or untreated control supernatants (FIG. 86).

Secretion of the Stimulatory Cytokine IFNγ

For detection of IFNγ expression, co-culture supernatants were diluted into 5% BSA/PBS assay buffer (in a range of 1:10 to 1:1000) and ELISA was carried out using the Human IFN gamma Quantikine kit (RandD Systems) according to the manufacturer's protocol. The concentration of secreted IFNγ was determined by interpolating from the standard curve. Expression of IFNγ could only be detected in the supernatants of co-cultures using NG-612 or NG-615 infected A549 supernatants (FIG. 87).

Example 36—EnAd Virus Co-Expressing a Bispecific T-Cell Activator Targeting FAP and a Bispecific T-Cell Activator Targeting EpCam The virus NG-618 was generated that encoded two bispecific T-cell activator molecules, one targeting EpCam (EpCam bispecific T-cell activator) and one targeting FAP (FAP bispecific T-cell activator) (Table 10).

TABLE 10

| Virus ID | Transgene Cassette |
| --- | --- |
| NG-618 (SEQ ID NO: 120) | SSA[1]-EpCAMbispecific T-cell activator[2]-P2A[3]-FAPbispecific T-cell activator[4]-PA[5] |

[1]SEQ ID NO. 55;
[2]SEQ ID NO. 121;
[3]SEQ ID NO. 106;
[4]SEQ ID NO. 122;
[5]SEQ ID NO. 65;

Virus Production

The plasmid pEnAd2.4 was used to generate the plasmid pNG-618 by direct insertion of a synthesised transgene cassettes (SEQ ID NO. 123). The NG-618 virus contains two transgenes encoding an EpCam targeting bispecific T-cell activator (SEQ ID NO. 93) and a FAP targeting bispecific T-cell activator (SEQ ID NO. 95). A schematic of the transgene cassette is shown in FIG. 88. Construction of plasmid DNA was confirmed by restriction analysis and DNA sequencing. The plasmid pNG-618, was linearised by restriction digest with the enzyme AscI to produce the virus genomes. The viruses were amplified and purified according to methods detailed in Example 33

T Cell Activation and Degranulation Mediated by Bispecific T-Cell Activator Expressing Viruses. Carcinoma Cell Infection A549 cells were seeded into 6 well plates at a density of 1.2e6 cells/well. Plates were incubated for 4 hrs, 37° C., 5% $CO_2$, before cells were either infected with NG-611, NG-612, NG-618, enadenotucirev or were left uninfected. At 72 hrs post-infection supernatants were harvested from the cells and clarified by centrifuging for 5 mins, 1200 rpm.

T Cell Assay

FAP expressing lung fibroblast cell lines MRC-5 and EpCam expressing A549 cells, were seeded into 24 well plates at a density of 1.5e5 cells/well. MRC-5 and A549 cells were also mixed at a 1 to 1 ratio and seeded in to 24 plates at a total cell density of 1.5e5 cells/well. Plates were incubated for 4 hrs, 37° C., 5% $CO_2$, before media was replaced with 300 μL/well of thawed supernatant harvested from the A549 plates. Purified CD3 T cells isolated form human PBMC donors were then also added to the plates to give a ratio of T cells to MRC-5 or SKOV3 cells of 2 to 1. The co-cultures were incubated for 16 hrs, 37° C., 5% $CO_2$ before cellular supernatants were collected for ELISA analysis and T, MRC-5 and A549 cells harvested for flow cytometry analysis.

Detection of FAP and EpCam on MRC-5 or SKOV Cells

Flow cytometry analysis of detectable FAP or EpCam on the surface of MRC-5 or SKOV cells, respectively was assessed by washing the cells once in FACs buffer before staining with panels of directly conjugated antibodies: anti-FAP conjugated to AF647; anti-EpCam conjugated to PE. Analysis showed that FAP expression was no longer detectable on the MRC-5 cells that had been incubated with supernatant from cells infected with FAP-bispecific T-cell activator expressing virus, NG-618 but was detected on >80% of cells incubated with supernatants from cells treated with EnAd, or the untreated cells (FIG. 89, panel A). These data indicate that FAP-bispecific T-cell activator produced by the NG-618 viruses binds to its FAP target on the MRC-5 cells occluding binding of the anti-FAP antibody. Live, large, single cells SKOV cells were assessed for detectable expression of EpCam. EpCam expression was only detectable at low levels on the SKOV cells that had been incubated with supernatants from cells infected with EpCam-bispecific T-cell activator expressing virus, NG-618 (17% of cells), but was detected on >40% of cells incubated with supernatants from cells treated with EnAd or the untreated cells (FIG. 89, panel B). Collectively these data indicate that NG-618 produces bispecific T-cell activator molecules that bind to EpCam and FAP target proteins.

Upregulation of T Cell Activation Markers

Flow cytometry analysis of T cell activation was assessed by expression of the T cell activation markers CD25, CD 69, HLA-DR and CD40L or the T cell degranulation marker, CD107a on live, CD3+, single cells. These data showed that when co-cultured with FAP MRC-5 cells the number of T cells expressing CD25, CD40L or CD107a was significantly increased when NG-618 supernantants were added to the cells compared enadenotucirev or untreated control supernatants (FIG. 90). The number of T cells expressing CD25, CD40L or CD107a was also significantly increased when NG-618 supernantants were added to the EpCam+ SKOV3 cells compared to enadenotucirev or untreated control supernatants (FIG. 91). These data demonstrate that both bispecific T-cell activator molecules expressed by the NG-618 virus are functional in terms of inducing T cell activation.

Analysis of T Cell Mediated Target (MRC-5 and SKOV) Cell Killing

Flow cytometry analysis of MRC-5 and SKOV cell viability was assessed by staining the cells in 504 of PBS containing Live/Dead Aqua (Life tech) for 15 minutes at RT. The cells were washed once in FACs buffer before staining with panels of directly conjugated antibodies: anti-FAP conjugated to AF647; anti-EpCam conjugated to PE. MRC-5 and SKOV cell viability was significantly reduced following incubation with NG-618 supernatant samples, whereas no significant cell death was detectable in the enadenotucirev or untreated control supernatants FIG. 92. These data demonstrate the functional ability of NG-618 coexpressed FAP and EpCam targeting bispecific T-cell activators to induce T cell mediated cell killing of target cells.

SEQUENCES

SEQ ID NO: 25: FAP bispecific T-cell activator-
P2A-RFP(*ITALICS* = leader,BOLD = furin cleavage
site, <u>UNDERLINE</u> = P2A sequence, lower case = RFP)
*MGWSCIILFLVATATGVHS*DIVMTQSPDSLAVSLGERATINCKSSQSLLY
SRNQKNYLAWYQQKPGQPPKLLIFWASTRESGVPDRFSGSGFGTDFTLTI
SSLQAEDVAVYYCQQYFSYPLTFGQGTKVEIKGGGSGGGGSGGGGSQVQ
LVQSGAEVKKPGASVKVSCKTSRYTFTEYTIHWVRQAPGQRLEWIGGINP
NNGIPNYNQKFKGRVTITVDTSASTAYMELSSLRSEDTAVYYCARRRIAY
GYDEGHAMDYWGQGTLVTVSSGGGGSDVQLVQSGAEVKKPGASVKVSCKA
SGYTFTRYTMHWVRQAPGQGLEWIGYINPSRGYTNYADSVKGRFTITTDK
STSTAYMELSSLRSEDTATYYCARYYDDHYCLDYWGQGTTVTVSSGEGTS
TGSGGSGGSGGADDIVLTQSPATLSLSPGERATLSCRASQSVSYMNWYQQ
KPGKAPKRWIYDTSKVASGVPARFSGSGSGTDYSLTINSLEAEDAATYYC
QQWSSNPLTFGGGTKVEIKHHHHHHHHHHRRKRGSGATNFSLLKQAGDVE
ENPGP<u>mselikenmhmklymegtvnnhhfkctsegegkpyegtqtmkikv
veggplpfafdilatsfmygskafinhtqgipdffkqsfpegftwreitt
yedggvltatqdtsfqngciiynvkingvnfpsngpvmqkktrgweante
mlypadgglrghsqmalklvgggylhcsfkttyrskkpaknlkmpgfhfv
dhrlerikeadketyveqhemavakycdlpsklghr</u>

SEQ ID NO: 26: Control (Anti-FHA) bispecific
T-cell activator P2A-RFP
(*ITALICS* = leader, BOLD = furin cleavage site,
<u>UNDERLINE</u> = P2A sequence, lower case = RFP)
*MGWSCIILFLVATATGVHS*ELDIVMTQAPASLAVSLGQRATISCRASKSV
SSSGYNYLHWYQQKPGQPPKLLIYLASNLESGVPARFSGSGSGTDFTLNI
HPVEEEDAATYYCQHSREFPLTFGAGTKLEIKSSGGGGSGGGGGGSRSS
LEVQLQQSGPELVKPGASVKISCKTSGYTFTGYTMHWVRQSHGKSLEWIG
GINPKNGGIIYNQKFQGKATLTVDKSSSTASMELRSLTSDDSAVYYCARR
VYDDYPYYAMDYWGQGTSVTVSSAKTTPPSVTSGGGGSDVQLVQSGAEV
KKPGASVKVSCKASGYTFTRYTMHWVRQAPGQGLEWIGYINPSRGYTNYA
DSVKGRFTITTDKSTSTAYMELSSLRSEDTATYYCARYYDDHYCLDYWGQ
GTTVTVSSGEGTSTGSGGSGGSGGADDIVLTQSPATLSLSPGERATLSCR
ASQSVSYMNWYQQKPGKAPKRWIYDTSKVASGVPARFSGSGSGTDYSLTI
NSLEAEDAATYYCQQWSSNPLTFGGGTKVEIKHHHHHHHHHHRRKRGSGA
TNFSLLKQAGDVEENPGP<u>mselikenmhmklymegtvnnhhfkctsegeg
kpyegtqtmkikvveggplpfafdilatsfmygskafinhtqgipdffkq
sfpegftwerittyedggvltatqdtsfqngciiynvkingvnfpsngpv
mqkktrgweantemlypadgglrghsqmalklvgggylhcsfkttyrskk
paknlkmpgfhfvdhrlerikeadketyveqhemavakycdlpsklghr</u>

SEQ ID NO: 33: Splice acceptor sequence
CAGG

SEQUENCE LISTING (298 sequences)

SEQ ID NO: 1 - DNA, 1578 bp, Artificial Sequence
  Anti-EpCAM bispecific T cell activator DNA coding sequence, with N-terminal signal sequence and C-terminal deca-His affinity tag
atgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattag

SEQ ID NO: 2 - protein, 525 aa, Artificial Sequence
  Anti-EpCAM bispecific T cell activator protein sequence, with N-terminal signal sequence and C-terminal deca-His affinity tag
MGWSCIILFLVATATGVHSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHH

SEQ ID NO: 3 - DNA, 1590 bp, Artificial Sequence
  Anti-FAP bispecific T cell activator DNA coding sequence, with N-terminal signal sequence and C-terminal deca-His affinity tag
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattag

SEQ ID NO: 4 - protein, 529 aa, Artificial Sequence
  Anti-FAP bispecific T cell activator amino acid sequence, with N-terminal signal sequence and C-terminal deca-His affinity tag
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHH

SEQ ID NO: 5 - DNA, 1629 bp, Artificial Sequence
  Control (Anti-FHA) bispecific T cell activator DNA coding sequence, with N-terminal signal sequence and C-terminal deca-His affinity tag
atgggttggtcatgcatcatcctgtttctcgtcgcaactgcgaccggcgtgcattcggaactggacatcgtgatgacccaggcacctgcatcactggcagtgagcctgggacagagagccaccatttcatgccgggccagcaagagcgtgtcgtcatccggatacaattatctgcactggtatcagcagaaaccaggacaacctccaaagctactcatctacctggcgtcgaacctcgaatcgggcgtcccagctagattctcagggagcggttcgggaaccgatttcaccctgaacatccaccctgtggaggaggaagacgcggcaacgtactattgccagcattcccgcgagttccctctcactttcggtgcgggaactaagctggagatcaagtccagcggcggcggaggtagcggtggaggtggcggaggaagctcccggtcgtcgctggaggtgcagctgcaacaatccggcccggaactggtcaagccaggcgcatccgtcaagatttcatgcaagacctcggggtacaccttcaccgggtacacgatgcattgggtcaggcagagccacggcaagtccctggaatggatcggaggaatcaaccccaaaaacggcggcatcatctacaaccaaaagttccagggaaaagccactctgaccgtggacaagtcgtcgagcacggccagcatggagctgcggtccctcacttccgacgactcagccgtgtattactgcgcgagacgggtctacgatgactacccatactactacgctatggactactggggacaaggaaccagcgtgaccgtctcatcggcgaaaactactccgccgtcggtgacgtcgggaggtggtggaagcgacgtgcagctcgtccagtcgggtgccgaggtgaagaagccaggagcctccgtgaaggtctcgtgcaaagccagcggctacacttttactaggtacactatgcactgggtgcggcaagcgccgggacaaggtctggagtggatcggatacatcaatccgtcgcggggatacactaattacgcggactccgtcaagggacggtttactatcactacggataagtccactagcaccgcctacatggaactgtcctcgctgcggtcggaagacactgcgacctactactgcgctagatattacgatgaccactactgcctcgactattgggggcagggcactacggtcaccgtctcgtcgggagaaggaacctcaactggatcgggcggatcgggaggctccggaggagccgacgacatcgtgcttacccagtcgcctgcgaccctgtccctgtccccaggagagagagcgactctttcatgcagggcttcccaatcagtctcctacatgaattggtatcaacaaaaacccggcaaggccccgaaacgctggatctacgatacttcaaaggtggccagcggtgtgcctgcccgcttctccgggtcggggtccggcaccgattactcgttgactatcaatagcctggaggccgaggacgctgcaacttactactgccagcagtggtcctccaaccctctcaccttcggaggcgggaccaaggtggaaatcaaacatcaccatcaccatcaccaccatcaccattag

SEQ ID NO: 6 - protein, 542 aa, Artificial Sequence
  Control (Anti-FHA) bispecific T cell activator amino acid sequence with N-terminal signal sequence and C-terminal deca-His affinity tag
MGWSCIILFLVATATGVHSELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHH

SEQ ID NO: 7 - protein, 243 aa, Artificial Sequence
  Anti-CD3 ScFv amino acid sequence
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 8 - protein, 119 aa, Artificial Sequence
  Anti-CD3 VH
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 9 - protein, 106 aa, Artificial Sequence
  Anti-CD3 VL
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 10 - protein, 18 aa, Artificial Sequence
  Anti-CD3 ScFv linker sequence
GEGTSTGSGGSGGSGGAD

SEQ ID NO: 11 - protein, 252 aa, Artificial Sequence
  Anti-FAP ScFv
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 12 - protein, 113 aa, Artificial Sequence
  Anti-FAP VL domain
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIK

SEQ ID NO: 13 - protein, 124 aa, Artificial Sequence
  Anti-FAP VH domain
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 14 - protein, 15 aa, Artificial Sequence
  Anti-FAP and Anti-EpCAM linker sequence
GGGGSGGGGSGGGGS

SEQ ID NO: 15 - protein, 19 aa, Artificial Sequence
  bispecific T cell activator leader sequence
MGWSCIILFLVATATGVHS

SEQ ID NO: 16 - protein, 248 aa, Artificial Sequence
  Anti-EpCAM ScFv
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 17 - protein, 113 aa, Artificial Sequence
  Anti-EpCAM VL
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 18 - protein, 120 aa, Artificial Sequence
  Anti-EpCAM VH
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 19 - protein, 542 aa, Artificial Sequence; identical to SEQ ID NO: 6
  Control bispecific T cell activator (Anti-FHA)

SEQ ID NO: 20 - protein, 265 aa, Artificial Sequence
  Control (Anti-FHA) ScFv
ELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTS

SEQ ID NO: 21 - protein, 113 aa, Artificial Sequence
  Control (Anti-FHA) VL
ELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIK

SEQ ID NO: 22 - protein, 133 aa, Artificial Sequence
  Control (Anti-FHA) VH
EVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTS

SEQ ID NO: 23 - protein, 19 aa, Artificial Sequence
  Control (Anti-FHA) ScFv linker sequence
SSGGGGSGGGGGGSSRSSL

SEQ ID NO: 24 - protein, 10 aa, Artificial Sequence
  Deca-His Tag sequence
HHHHHHHHHH

SEQ ID NO: 25 - protein, 786 aa, Artificial Sequence
  FAP bispecific T cell activator-P2A-RFP
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHHRRKRGSGATNFSLLKQAGDVEENPGPMSELIKENMHMKLYMEGTVNNHHFKCTSEGEGKPYEGTQTMKIKVVEGGPLPFAFDILATSFMYGSKAFINHTQGIPDFFKQSFPEGFTWERITTYEDGGVLTATQDTSFQNGCIIYNVKINGVNFPSNGPVMQKKTRGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 26 - protein, 799 aa, Artificial Sequence
  Control (Anti-FHA) bispecific T cell activator-P2A-RFP
MGWSCIILFLVATATGVHSELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHHHHRRKRGSGATNFSLLKQAGDVEENPGPMSELIKENMHMKLYMEGTVNNHHFKCTSEGEGKPYEGTQTMKIKVVEGGPLPFAFDILATSFMYGSKAFINHTQGIPDFFKQSFPEGFTWERITTYEDGGVLTATQDTSFQNGCIIYNVKINGVNFPSNGPVMQKKTRGWEANTEMLYPADGGLRGHSQMALKLVGGGYLHCSFKTTYRSKKPAKNLKMPGFHFVDHRLERIKEADKETYVEQHEMAVAKYCDLPSKLGHR

SEQ ID NO: 27 - DNA, 945 bp, Artificial Sequence
  Human EpCAM DNA coding sequence
atggctccgccgcaagtgctcgcctttggactgctcctggccgctgctactgccacctttgctgccgctcaggaagaatgcgtgtgcgaaaactacaaactggcagtgaactgcttcgtgaacaataaccgccaatgccagtgcaccagcgtgggcgcgcagaacactgtcatctgcagcaagctggccgcaaaatgcctggtcatgaaagcggagatgaacggatcgaagctgggtcggcgcgctaagccggaaggagcgctacaaaataacgacgggctgtacgatccggattgcgacgaaagcggtctgtttaaggcaaagcagtgtaatgggaccagcatgtgttggtgcgtgaacactgccggagtgcgccgcactgacaaggataccgaaattacgtgctcggagcgcgtgagaacgtattggatcatcatcgagttgaagcataaagctagagagaagccgtacgatagcaagtccctgcgcaccgctctccaaaaagaaattaccactagataccaactcgacccgaaattcatcacttcaatcctgtacgaaaacaacgtgattacgatcgacctggtgcagaactccagccaaaagacgcagaacgacgtggacattgcagacgtggcttactactttgaaaaggacgtgaagggggaatcactatttcattccaagaaaatggacctgaccgtcaacggagagcagctcgacctggacccaggtcagactctgatctactacgtggacgagaaggcaccggagttttcgatgcagggcctgaaagccggagtcatcgccgtgatcgtggtggtggtgattgccgtcgtcgccgggatcgtggtgctcgtgattagccgcaaaaagagaatggctaagtatgaaaaggcagagatcaaggaaatgggagaaatgcaccgcgaactcaacgcatag

SEQ ID NO: 28 - protein, 314 aa, Artificial Sequence
  Human EpCAM amino acid sequence
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 29 - DNA, 2283 bp, Artificial Sequence
  Human FAP DNA coding sequence
atgaagacctgggtgaaaatcgtgtttggagtcgcaaccagcgccgtgctggccctgttggtgatgtgcatcgtgctgcgcccgtcacgcgtgcataacagcgaagaaaacaccatgagagctctgacgctaaaggacatcctgaatggcactttttcctataagactttcttcccgaattggattagcgggcaggagtacctgcaccaatcggcggataacaatatcgtgctctacaacatcgaaactggccagagctacaccatcctgtcgaatagaactatgaaatcggtgaatgcgtcgaactacggacttagcccggaccgccagttcgtgtacctagaatcggactacagcaagctgtggcggtacagctacactgctacgtactacatctacgacctgtcgaatggcgagttcgtgagaggaaacgaactcccccgcccgatccaatacctgtgctggagccctgtgggaagcaagctggcgtacgtgtatcagaacaacatctacctcaagcagaggccgggcgacccacctttccagatcacttttaacggtcgggagaacaagattttcaatggaatcccggattgggtgtacgaagaagagatgctggcgaccaaatatgcgctctggtggtcgccaaacggaaaatttctagcatacgccgagttcaatgacaccgacatccccgtcatcgcctacagctactacggagatgagcaatacccacgcactattaatatcccgtacccgaaagccggcgctaaaaatccggtcgtgcggatcttcatcatcgacactacctatccagcttacgtgggaccgcaagaggtccctgtgccagccatgatcgccagcagcgattactacttctcctggctgacttgggtcactgacgagagggtgtgcctccaatggctcaagcgcgtgcagaacgtgagcgtgctgtccatctgcgacttcagagaagattggcaaacgtgggactgtccgaaaactcaagagcatatcgaggagagcagaaccggatgggcaggggggttcttcgtgtccaccccggtgttcagctacgatgcgatctcgtactacaagattttctccgataaggacgggtacaaacatatccactacatcaaggacaccgtggagaatgcgatccaaatcactagcggaaaatgggaagcgattaacattttccgggtgacgcaagactcattgttctattcatccaatgaatttgaagagtaccctggccggaggaacatctaccgcatctccatcggatcatacccaccatcaaagaagtgcgtgacctgccatctccgcaaggagcgctgccaatactacaccgcgtccttctccgattacgcgaagtactacgccctggtgtgctacggcccgggaatcccaatctcgaccctacatgatgggcgcaccgaccaggagatcaaaatcctggaggaaaacaaggagctcgaaaatgctctgaaaaatattcaactaccgaaggaggaaatcaagaagctggaggtggatgaaattactctgtggtacaaaatgatcctgccgccacagttcgaccgctccaagaagtacccgctgctgatccaggtgtacggaggaccctgctcacagtcggtgcgctcagtgtttgctgtgaattggatcagctacctcgcatcaaaggaggggatggtcatcgcgcttgtggacggaagaggtactgcattccagggggacaaactgctctacgcggtgtaccgcaagctgggcgtctacgaggtggaggaccaaatcacggcggtcagaaagttcatcgagatgggtttcatcgacgagaagaggatcgccatctggggctggtcgtacggaggttacgtgtcgtcactcgctctggcgagcgggactggattgttcaaatgcggtatcgcagtcgcccccgtgtcgtcatgggaatactacgcctcggtgtataccgaacgctttatgggactccctactaaagacgataacctagagcactacaaaaactcgacggtgatggcacgcgcagagtactttcgcaatgtggattacctcctgatccacggaaccgccgatgataatgtccacttccagaactcagcccaaatcgcgaaagccctggtgaacgctcaagtggactttcaagcaatgtggtattcagaccagaaccacggactatccggcctatcgactaatcacctgtacacccatatgacccatttccttaaacagtgtttcagcctgtccgattag

SEQ ID NO: 30 - protein, 760 aa, Artificial Sequence
  Human FAP amino acid sequence
MKTWVKIVFGVATSAVLALLVMCIVLRPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSD

SEQ ID NO: 31 - DNA, 571 bp, Artificial Sequence
  CMV promoter sequence
agtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccg

SEQ ID NO: 32 - DNA, 192 bp, Artificial Sequence
  SV40 late polyadenylation sequence
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggtttttt

SEQ ID NO: 33 - skipped

SEQ ID NO: 34 - DNA, 34883 bp, Artificial Sequence
  NG-601 (EnAd-CMV-EpCAM bispecific T cell activator)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 35 - DNA, 34204 bp, Artificial Sequence
  NG-602 (EnAd-SA-EpCAM bispecific T cell activator)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 36 - DNA, 34895 bp, Artificial Sequence
  NG-605 (EnAd-CMV-FAP bispecific T cell activator)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 37 - DNA, 34216 bp, Artificial Sequence
  NG-606 (EnAd-SA-FAP bispecific T cell activator)
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 38 - DNA, 32326 bp, Artificial Sequence
  EnAd genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 39 - DNA, 201 bp, Artificial Sequence
  Bx DNA sequence corresponding to and including bp 28166-28366 of the EnAd genome
aaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccag

SEQ ID NO: 40 - DNA, 35 bp, Artificial Sequence
  By DNA sequence corresponding to and including bp 29345-29379 of the EnAd genome
caaataaagtttaacttgtttatttgaaaatcaat

SEQ ID NO: 41 - protein, 6 aa, Artificial Sequence
  His Tag
HHHHHH

SEQ ID NO: 42 - DNA, 14 bp, Artificial Sequence
  Splice acceptor
tttctctcttcagg

SEQ ID NO: 43 - DNA, 192 bp, Artificial Sequence; identical to SEQ ID NO: 32
  SV40 poly Adenylation sequence

SEQ ID NO: 44 - DNA, 1539 bp, Artificial Sequence
  EpCam bispecific T cell activator nucleic acid sequence (OKT3)
atgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccgg

SEQ ID NO: 45 - DNA, 1551 bp, Artificial Sequence
  FAP bispecific T cell activator nucleic acid sequence (OKT3)
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccgg

SEQ ID NO: 46 - DNA, 1557 bp, Artificial Sequence
  FAP bispecific T cell activator nucleic acid sequence (aCD3)
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaag

SEQ ID NO: 47 - DNA, 1856 bp, Artificial Sequence
  NG-611 Transgene cassette
caggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 48 - DNA, 1868 bp, Artificial Sequence
  NG-612 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 49 - DNA, 1878 bp, Artificial Sequence
  NG-613 Transgene cassette
tttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 50 - DNA, 19 bp, Artificial Sequence
  Restriction site insert (Bx)
gcggccgctatggccggcc

SEQ ID NO: 51 - DNA, 19 bp, Artificial Sequence
  Restriction site insert (By)
gcgatcgctaccctgcagg

SEQ ID NO: 52 - DNA, 572 bp, Artificial Sequence
  CMV promoter sequence
agtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgt

SEQ ID NO: 53 - DNA, 505 bp, Artificial Sequence
  PGK promoter sequence
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctacccctcccctagtcaggaagttcccccccgccccgcagctcgcgtcatgcaggacgtgacaaatggaagtagcacgtctcactagtctcgtgcaaatggacagcaccgctgagcaatggaagcgggtaggcccttggggcagcggccaatagcagctttgctccttcgctttctgggctcagaggctgggaaggggtgggtccgggggcgggctcaggggcgggctcaggggcggggcgggcgcccgaaggtcctccggaggcccggcattccgcacgcttcaaaagcgcacgtctgccgcgctgttctcttcttcctcatctccgggcctttcg

SEQ ID NO: 54 - DNA, 367 bp, Artificial Sequence
  CBA promoter sequence
gtcgaggtgagccccacgttctgcttcactctccccatctcccccccctccccacccccaattttgtatttatttattttttaattattttatgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacag

SEQ ID NO: 55 - skipped

SEQ ID NO: 56 - DNA, 16 bp, Artificial Sequence
  splice acceptor (SA) DNA sequence
cctttctctcttcagg

SEQ ID NO: 57 - DNA, 23 bp, Artificial Sequence
  branched splice acceptor (bSA) DNA sequence
tgctaatcctttctctcttcagg

SEQ ID NO: 58 - skipped

SEQ ID NO: 59 - RNA, 13 nt, Artificial Sequence
  Example of start codon
  misc_feature (11)..(11): R is adenine or guanine
gccgccrccaugg

SEQ ID NO: 60 - DNA, 551 bp, Artificial Sequence
  Internal Ribosome Entry Sequence (IRES)
cgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctcccctcaagcgtattcaacaaggggctgaaggatgcccagaaggtaccccattgtatgggatctgatctggggcctcggtgcacatgcttttcatgtgtttagtcgaggttaaaaaacgtctaggccccccgaaccacggggacgtggttttcctttgaaaaacacgatgataata

SEQ ID NO: 61 - protein, 22 aa, Artificial Sequence
  P2A peptide
GSGATNFSLLKQAGDVEENPGP

SEQ ID NO: 62 - protein, 21 aa, Artificial Sequence
  F2A peptide
GSGEGRGSLLTCGDVEENPGP

SEQ ID NO: 63 - protein, 23 aa, Artificial Sequence
  E2A peptide
GSGQCTNYALLKLAGDVESNPGP

SEQ ID NO: 64 - protein, 25 aa, Artificial Sequence
  T2A peptide
GSGVKQTLNFDLLKLAGDVESNPGP

SEQ ID NO: 65 - DNA, 192 bp, Artificial Sequence; identical to SEQ ID NO: 32
  polyadenylation (polyA) sequence

SEQ ID NO: 66 - protein, 19 aa, Artificial Sequence
  Leader sequence
MGWSCIILFLVATATGVHS

SEQ ID NO: 67 - protein, 19 aa, Artificial Sequence
  Leader sequence
MDWTWRVFCLLAVAPGAHS

SEQ ID NO: 68 - protein, 166 aa, Artificial Sequence
  IFN gamma  amino acid sequence
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 69 - protein, 188 aa, Artificial Sequence
  IFN alpha amino acid sequence
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 70 - protein, 233 aa, Artificial Sequence
  TNF alpha amino acid sequence
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 71 - DNA, 5288 bp, Artificial Sequence
  DNA sequence corresponding to E2B region of the EnAd genome (bp 10355-5068)
ctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcat

SEQ ID NO: 72 - DNA, 1548 bp, Artificial Sequence
  Anti-EpCAM bispecific T cell activator DNA coding sequence, with N-terminal signal sequence and C-terminal deca-His affinity tag
atgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtag

SEQ ID NO: 73 - protein, 515 aa, Artificial Sequence
  Anti-EpCAM bispecific T cell activator protein sequence, with N-terminal signal sequence without C-terminal deca-His affinity tag
MGWSCIILFLVATATGVHSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 74 - DNA, 1560 bp, Artificial Sequence
  Anti-FAP bispecific T cell activator DNA coding sequence, with N-terminal signal sequence without C-terminal deca-His affinity tag
atgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtag

SEQ ID NO: 75 - protein, 519 aa, Artificial Sequence
  Anti-FAP bispecific T cell activator amino acid sequence, with N-terminal signal sequence without C-terminal deca-His affinity tag
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 76 - DNA, 1599 bp, Artificial Sequence
  Control (Anti-FHA) bispecific T cell activator DNA coding sequence, with N-terminal signal sequence without C-terminal deca-His affinity tag
atgggttggtcatgcatcatcctgtttctcgtcgcaactgcgaccggcgtgcattcggaactggacatcgtgatgacccaggcacctgcatcactggcagtgagcctgggacagagagccaccatttcatgccgggccagcaagagcgtgtcgtcatccggatacaattatctgcactggtatcagcagaaaccaggacaacctccaaagctactcatctacctggcgtcgaacctcgaatcgggcgtcccagctagattctcagggagcggttcgggaaccgatttcaccctgaacatccaccctgtggaggaggaagacgcggcaacgtactattgccagcattcccgcgagttccctctcactttcggtgcgggaactaagctggagatcaagtccagcggcggcggaggtagcggtggaggtggcggaggaagctcccggtcgtcgctggaggtgcagctgcaacaatccggcccggaactggtcaagccaggcgcatccgtcaagatttcatgcaagacctcggggtacaccttcaccgggtacacgatgcattgggtcaggcagagccacggcaagtccctggaatggatcggaggaatcaaccccaaaaacggcggcatcatctacaaccaaaagttccagggaaaagccactctgaccgtggacaagtcgtcgagcacggccagcatggagctgcggtccctcacttccgacgactcagccgtgtattactgcgcgagacgggtctacgatgactacccatactactacgctatggactactggggacaaggaaccagcgtgaccgtctcatcggcgaaaactactccgccgtcggtgacgtcgggaggtggtggaagcgacgtgcagctcgtccagtcgggtgccgaggtgaagaagccaggagcctccgtgaaggtctcgtgcaaagccagcggctacacttttactaggtacactatgcactgggtgcggcaagcgccgggacaaggtctggagtggatcggatacatcaatccgtcgcggggatacactaattacgcggactccgtcaagggacggtttactatcactacggataagtccactagcaccgcctacatggaactgtcctcgctgcggtcggaagacactgcgacctactactgcgctagatattacgatgaccactactgcctcgactattgggggcagggcactacggtcaccgtctcgtcgggagaaggaacctcaactggatcgggcggatcgggaggctccggaggagccgacgacatcgtgcttacccagtcgcctgcgaccctgtccctgtccccaggagagagagcgactctttcatgcagggcttcccaatcagtctcctacatgaattggtatcaacaaaaacccggcaaggccccgaaacgctggatctacgatacttcaaaggtggccagcggtgtgcctgcccgcttctccgggtcggggtccggcaccgattactcgttgactatcaatagcctggaggccgaggacgctgcaacttactactgccagcagtggtcctccaaccctctcaccttcggaggcgggaccaaggtggaaatcaaatag

SEQ ID NO: 77 - protein, 532 aa, Artificial Sequence
  Control (Anti-FHA) bispecific T cell activator amino acid sequence with N-terminal signal sequence without C-terminal deca-His tag
MGWSCIILFLVATATGVHSELDIVMTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 78 - protein, 532 aa, Artificial Sequence; identical to SEQ ID NO: 77
  Control bispecific T cell activator (Anti-FHA) without C-terminal deca-His tag

SEQ ID NO: 79 - DNA, 34853 bp, Artificial Sequence
  NG-601 (EnAd-CMV-EpCAM bispecific T cell activator) without deca-His affinity tag
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 80 - DNA, 34174 bp, Artificial Sequence
  NG-602 (EnAd-SA-EpCAM bispecific T cell activator) without deca-His affinity tag
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagcgatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 81 - DNA, 34865 bp, Artificial Sequence
  NG-605 (EnAd-CMV-FAP bispecific T cell activator) without deca-His tag
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggggctcccgccagatctagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgctgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatcagatctttgtcgatcctaccatccactcgacacacccgccagcggccgctgccaagcttccgagctctcgaattcaaaggaggtacccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 82 - DNA, 34186 bp, Artificial Sequence
  NG-606 (EnAd-SA-FAP bispecific T cell activator) without deca-His tag
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 83 - DNA, 1539 bp, Artificial Sequence; identical to SEQ ID NO: 44
  EpCam bispecific T cell activator nucleic acid sequence (OKT3)

SEQ ID NO: 84 - skipped

SEQ ID NO: 85 - DNA, 1551 bp, Artificial Sequence; identical to SEQ ID NO: 45
  FAP bispecific T cell activator nucleic acid sequence (OKT3)

SEQ ID NO: 86 - skipped

SEQ ID NO: 87 - DNA, 1557 bp, Artificial Sequence; identical to SEQ ID NO: 46
  FAP bispecific T cell activator nucleic acid sequence (aCD3)

SEQ ID NO: 88 - DNA, 1856 bp, Artificial Sequence; identical to SEQ ID NO: 47
  NG-611 Transgene cassette

SEQ ID NO: 89 - DNA, 1868 bp, Artificial Sequence; identical to SEQ ID NO: 48
  NG-612 Transgene cassette

SEQ ID NO: 90 - DNA, 1878 bp, Artificial Sequence; identical to SEQ ID NO: 49
  NG-613 Transgene cassette

SEQ ID NO: 91 - DNA, 1884 bp, Artificial Sequence
  NG-614 Transgene cassette
tttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 92 - DNA, 1838 bp, Artificial Sequence
  NG-617 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 93 - protein, 513 aa, Artificial Sequence
  EpCam bispecific T cell activator amino acid sequence (OKT3)
MGWSCIILFLVATATGVHSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 94 - protein, 517 aa, Artificial Sequence
  FAP bispecific T cell activator amino acid sequence (OKT3)
MGWSCIILFLVATATGVHSDIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIKGGGGSGGGGSGGGGSQVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSDIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 95 - protein, 519 aa, Artificial Sequence; identical to SEQ ID NO: 75
  FAP bispecific T cell activator amino acid sequence (aCD3)

SEQ ID NO: 96 - DNA, 34198 bp, Artificial Sequence
  NG-611 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggatggagctgcatcatcctattcctcgtggcgacggccactggagtgcatagcgaactggtgatgactcagtccccgtcatccctgacggtgaccgccggcgagaaggtcaccatgtcgtgcaagtcctcgcaaagcctgcttaacagcggcaaccagaaaaactacctcacgtggtatcagcaaaagccaggtcaacccccaaaactgctcatctactgggcgagcacccgcgagtcgggggtgccagaccggttcaccggctccgggtcaggaactgatttcaccctaaccatcagctcggtgcaagcggaggacctggccgtgtactactgccaaaatgattactcgtaccctctgacctttggagcgggcaccaagctcgaaatcaagggcggtggaggaagcggcgggggaggctcaggtgggggaggatcagaagtccaactgctggagcagtcaggagccgaactggtccgcccgggaacctccgtcaagatttcctgtaaggcttccggctacgcttttaccaattactggctgggctgggtcaagcaaagaccggggcatggcctggagtggatcggcgacatcttcccagggagcggcaacatccactacaacgagaagttcaaggggaaagcgactctgactgccgacaaatcatccagcaccgcctacatgcagctgtcgtcgctcactttcgaagacagcgcggtgtacttttgtgctcggctccggaactgggatgaaccaatggactactggggacaaggaactaccgtgaccgtctcctccggcggcggtggaagccaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 97 - DNA, 34210 bp, Artificial Sequence
  NG-612 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 98 - DNA, 34220 bp, Artificial Sequence
  NG-613 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 99 - DNA, 34226 bp, Artificial Sequence
  NG-614 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcagatgtgcaactcgtgcagtccggtgcggaagtgaaaaagccgggcgcgagcgtcaaagtgtcatgcaaggcgtcaggatatacgtttactagatacactatgcactgggtgcgccaggcacctggtcagggccttgaatggatcggctacatcaatccgtcgagaggctacactaattacgcggactcagtcaaagggcgcttcacgattacgaccgacaagtccacctcgactgcatacatggaactgtcctcgctgagaagcgaggacaccgctacttactactgcgctagatactacgatgatcactactgcctcgattactggggccagggaaccactgtcacggtgtcatcgggagagggcacctcaaccggatcagggggatcgggaggctcgggcggcgcagacgacatcgtcctgacccagtcgcccgccaccttgtcgctgtccccaggagaaagagcgaccctgtcatgccgggcgtcgcaaagcgtgagctatatgaattggtatcagcagaagccaggaaaggcgccgaagagatggatctacgacacctccaaggtcgcttcaggtgtcccggctagattctcaggatcgggatcaggaacggactactccctgaccatcaattcactggaagcagaagatgcggccacctactactgtcagcagtggtcctccaacccgctgactttcggaggcggaactaaggtcgagatcaagcatcaccatcaccatcaccaccatcaccattaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 100 - DNA, 34180 bp, Artificial Sequence
  NG-617 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 101 - DNA, 35749 bp, Artificial Sequence
  NG-615 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 102 - DNA, 34972 bp, Artificial Sequence
  NG-640 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 103 - DNA, 35602 bp, Artificial Sequence
  NG-641 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacaggaagcggacagtgtactaattatgctctcttgaaattggctggagatgttgagagcaaccctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 104 - skipped

SEQ ID NO: 105 - DNA, 537 bp, Artificial Sequence
  Flt3L nucleic acid sequence
atgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccg

SEQ ID NO: 106 - skipped

SEQ ID NO: 107 - DNA, 279 bp, Artificial Sequence
  MIP1 alpha nucleic acid sequence
atgcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgcc

SEQ ID NO: 108 - protein, 18 aa, Artificial Sequence
  Flexible linker sequence
SPQYPSPLTLTLPPHPSL

SEQ ID NO: 109 - DNA, 564 bp, Artificial Sequence
  IFN alpha nucleic acid sequence
atggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 110 - DNA, 294 bp, Artificial Sequence
  CXCL10 nucleic acid sequence
atgaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcct

SEQ ID NO: 111 - DNA, 372 bp, Artificial Sequence
  CXCL9 nucleic acid sequence
aagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactaca

SEQ ID NO: 112 - DNA, 3407 bp, Artificial Sequence
  NG-615 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 113 - DNA, 2630 bp, Artificial Sequence
  NG-640 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 114 - DNA, 3260 bp, Artificial Sequence
  NG-641 Transgene cassette
caggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggagctactaacttcagcctgctgaagcaggctggagacgtggaggagaaccctggacctaatcaaactgccattctgatttgctgccttatctttctgactctaagtggcattcaaggagtacctctctctagaactgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaaggtctaaaagatctcctggaagcggagagggcagaggaagtctgctaacatgcggtgacgtcgaggagaatcctggacctaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacaggaagcggacagtgtactaattatgctctcttgaaattggctggagatgttgagagcaaccctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctat

SEQ ID NO: 115 - protein, 154 aa, Artificial Sequence
  FLT3L amino acid sequence
MTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAP

SEQ ID NO: 116 - protein, 93 aa, Artificial Sequence
  MIP1 alpha amino acid sequence
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 117 - protein, 188 aa, Artificial Sequence; identical to SEQ ID NO: 69
  IFN alpha amino acid sequence

SEQ ID NO: 118 - protein, 125 aa, Artificial Sequence
  CXCL9 amino acid sequence
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 119 - protein, 98 aa, Artificial Sequence
  CXCL10 amino acid sequence
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 120 - DNA, 35788 bp, Artificial Sequence
  NG-618 Genome
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgccaggcccaccatgggttggagctgtattattctcttcctcgtcgccaccgcgaccggagtgcattccgagctcgtgatgacccagtcaccatcatccttgaccgtgactgcgggcgagaaggtcacgatgtcatgcaagtcgtcacaaagcctgctgaactccggcaatcagaagaattacctgacctggtaccagcagaaaccgggtcagccgccaaaactgctgatctactgggcatccacccgggaaagcggggtccctgaccggttcactggatcaggatcaggaaccgactttaccctcacgatctcaagcgtccaagccgaggacttggctgtgtactactgccaaaatgactactcgtaccccctgactttcggagctgggaccaagctggagatcaaaggcggcggagggtccggaggaggggggtcgggaggggggggaagcgaggtgcagctgctggaacagagcggagccgagctggtgagaccaggcaccagcgtgaaaatctcgtgcaaggcctcggggtacgctttcacgaactactggttgggttgggtgaagcagcggccgggtcatggactggagtggatcggagacatctttcccggaagcggaaatatccattacaacgaaaagtttaaaggcaaggccacccttactgcggataagtcaagctccaccgcttacatgcaactgtcctcactgacttttgaagacagcgctgtgtatttctgcgctcgcctgcgcaattgggatgaacctatggactactggggccaaggaaccaccgtgactgtgtcgtcgggagggggaggctcacaagtgcagctgcagcagtcaggtgcagaattggccaggccgggagccagcgtgaagatgtcgtgcaaagcctccggctacaccttcactcgctacactatgcattgggtgaaacagcggccgggacaagggctggagtggatcggatacatcaatccatcaagaggttacaccaactacaatcagaagttcaaggacaaggctaccctgacgactgataagagctcgtcaactgcatacatgcagctgtcgagcctgaccagcgaggattccgccgtgtactactgcgcgagatactatgatgaccactactgcttggattactggggccaagggaccactctgaccgtgtcctccggcggagggggctcgggcggcgggggctcggggggcggcggcagcgacatcgtgctgacgcagagccccgcaatcatgtcagcctcccctggcgaaaaagtgacgatgacctgctccgcttcctcatcagtctcctacatgaactggtatcaacagaagagcggaacctcgccgaagcgctggatctacgatacctccaaactggccagcggagtgccggcgcattttcggggatcgggcagcggtacctcctactcgctcaccatctcaggaatggaagccgaagacgccgccacctactactgccagcagtggtcctcaaacccattcaccttcggatccggcactaagctggaaatcaaccgcgggagcggagcgactaacttcagcttgctcaagcaagccggagatgtcgaggagaacccgggacctggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaagtaggctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

SEQ ID NO: 121 - DNA, 1540 bp, Artificial Sequence
  NG-618 EpCam bispecific T cell activator nucleic acid sequence
atgggttggagctgtattattctcttcctcgtcgccaccgcgaccggagtgcattccgagctcgtgatgacccagtcaccatcatccttgaccgtgactgcgggcgagaaggtcacgatgtcatgcaagtcgtcacaaagcctgctgaactccggcaatcagaagaattacctgacctggtaccagcagaaaccgggtcagccgccaaaactgctgatctactgggcatccacccgggaaagcggggtccctgaccggttcactggatcaggatcaggaaccgactttaccctcacgatctcaagcgtccaagccgaggacttggctgtgtactactgccaaaatgactactcgtaccccctgactttcggagctgggaccaagctggagatcaaaggcggcggagggtccggaggaggggggtcgggaggggggggaagcgaggtgcagctgctggaacagagcggagccgagctggtgagaccaggcaccagcgtgaaaatctcgtgcaaggcctcggggtacgctttcacgaactactggttgggttgggtgaagcagcggccgggtcatggactggagtggatcggagacatctttcccggaagcggaaatatccattacaacgaaaagtttaaaggcaaggccacccttactgcggataagtcaagctccaccgcttacatgcaactgtcctcactgacttttgaagacagcgctgtgtatttctgcgctcgcctgcgcaattgggatgaacctatggactactggggccaaggaaccaccgtgactgtgtcgtcgggagggggaggctcacaagtgcagctgcagcagtcaggtgcagaattggccaggccgggagccagcgtgaagatgtcgtgcaaagcctccggctacaccttcactcgctacactatgcattgggtgaaacagcggccgggacaagggctggagtggatcggatacatcaatccatcaagaggttacaccaactacaatcagaagttcaaggacaaggctaccctgacgactgataagagctcgtcaactgcatacatgcagctgtcgagcctgaccagcgaggattccgccgtgtactactgcgcgagatactatgatgaccactactgcttggattactggggccaagggaccactctgaccgtgtcctccggcggagggggctcgggcggcgggggctcggggggcggcggcagcgacatcgtgctgacgcagagccccgcaatcatgtcagcctcccctggcgaaaaagtgacgatgacctgctccgcttcctcatcagtctcctacatgaactggtatcaacagaagagcggaacctcgccgaagcgctggatctacgatacctccaaactggccagcggagtgccggcgcattttcggggatcgggcagcggtacctcctactcgctcaccatctcaggaatggaagccgaagacgccgccacctactactgccagcagtggtcctcaaacccattcaccttcggatccggcactaagctggaaatcaaccgcg

SEQ ID NO: 122 - DNA, 1557 bp, Artificial Sequence
  NG-618 FAP bispecific T cell activator nucleic acid sequence
atgggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaag

SEQ ID NO: 123 - DNA, 3169 bp, Artificial Sequence
  NG-618 Transgene cassette
caggcccaccatgggttggagctgtattattctcttcctcgtcgccaccgcgaccggagtgcattccgagctcgtgatgacccagtcaccatcatccttgaccgtgactgcgggcgagaaggtcacgatgtcatgcaagtcgtcacaaagcctgctgaactccggcaatcagaagaattacctgacctggtaccagcagaaaccgggtcagccgccaaaactgctgatctactgggcatccacccgggaaagcggggtccctgaccggttcactggatcaggatcaggaaccgactttaccctcacgatctcaagcgtccaagccgaggacttggctgtgtactactgccaaaatgactactcgtaccccctgactttcggagctgggaccaagctggagatcaaaggcggcggagggtccggaggaggggggtcgggaggggggggaagcgaggtgcagctgctggaacagagcggagccgagctggtgagaccaggcaccagcgtgaaaatctcgtgcaaggcctcggggtacgctttcacgaactactggttgggttgggtgaagcagcggccgggtcatggactggagtggatcggagacatctttcccggaagcggaaatatccattacaacgaaaagtttaaaggcaaggccacccttactgcggataagtcaagctccaccgcttacatgcaactgtcctcactgacttttgaagacagcgctgtgtatttctgcgctcgcctgcgcaattgggatgaacctatggactactggggccaaggaaccaccgtgactgtgtcgtcgggagggggaggctcacaagtgcagctgcagcagtcaggtgcagaattggccaggccgggagccagcgtgaagatgtcgtgcaaagcctccggctacaccttcactcgctacactatgcattgggtgaaacagcggccgggacaagggctggagtggatcggatacatcaatccatcaagaggttacaccaactacaatcagaagttcaaggacaaggctaccctgacgactgataagagctcgtcaactgcatacatgcagctgtcgagcctgaccagcgaggattccgccgtgtactactgcgcgagatactatgatgaccactactgcttggattactggggccaagggaccactctgaccgtgtcctccggcggagggggctcgggcggcgggggctcggggggcggcggcagcgacatcgtgctgacgcagagccccgcaatcatgtcagcctcccctggcgaaaaagtgacgatgacctgctccgcttcctcatcagtctcctacatgaactggtatcaacagaagagcggaacctcgccgaagcgctggatctacgatacctccaaactggccagcggagtgccggcgcattttcggggatcgggcagcggtacctcctactcgctcaccatctcaggaatggaagccgaagacgccgccacctactactgccagcagtggtcctcaaacccattcaccttcggatccggcactaagctggaaatcaaccgcgggagcggagcgactaacttcagcttgctcaagcaagccggagatgtcgaggagaacccgggacctggttggtcgtgcatcatcctattccttgtcgcgaccgcaactggcgtccattccgacatcgtcatgacccaatccccagattcgctggcggtgtcgcttggggaacgggcaaccatcaactgcaagagctcgcagtcactgctatacagccggaatcagaaaaactacctggcgtggtaccagcaaaagccgggtcagcctccgaagctgctgattttctgggcctcaacccgggaatccggagtccctgacagattcagcgggtccggattcgggaccgacttcactctgactatttcgagcctgcaagcagaagatgtggcagtgtactattgccaacagtatttttcatacccgctgaccttcggccagggtacgaaggtggagatcaagggtggagggggtagcggcgggggaggcagcggcggggggggaagccaggtgcagctggtccaatcaggcgccgaggtcaagaaacctggagcgtcggtcaaggtctcctgcaagactagccgctacacttttaccgaatacaccatccactgggtcagacaggcgcccggtcagcgcctggagtggatcggcgggatcaacccgaataatggaatcccgaactacaatcaaaaattcaaaggccgcgtgactatcaccgtggatacttcagcctcaactgcttacatggaactgtcatcgctgagatcagaggacactgcggtctactactgtgcgcgcagaagaatcgcttacggatacgacgaggggcacgcaatggactactggggacagggaaccctggtgaccgtgtcgtcaggcggaggaggatcggatgtgcagttggtgcagtcgggcgccgaagtgaaaaaaccgggggcctcagtgaaagtgtcctgcaaggcctccggatacaccttcacccgctacactatgcactgggtcaggcaggcgcccgggcagggcctggagtggatcgggtatatcaacccgtcaaggggatacactaactacgccgactccgtgaagggaagattcactatcaccactgacaaatcaacttcgacggcgtatatggaactgtcatccttgagatcggaagataccgcgacctactactgtgcgcgctactacgatgaccattactgcctcgattactggggacagggcaccacggtgaccgtctcatcaggagaaggaacttcaactggttccggaggctccggcggctcaggcggcgctgacgacattgtgctgacccagagcccggcgaccctgtcactctcgccgggggaaagggctactctgtcatgcagagcgtcacaatcggtctcatacatgaactggtaccagcagaaaccgggcaaggctccaaagcggtggatctacgatacttcgaaggtggcttcaggagtgccggctcgcttcagcggatccggctcgggaaccgattacagcttgaccattaactcgctggaggcggaggatgcagcgacctactactgtcaacaatggtcctcgaacccactcacttttgggggcgggaccaaggtggagattaag

SEQ ID NO: 124 - protein, 7 aa, Artificial Sequence
  Flexible linker sequence
SGGGGSE

SEQ ID NO: 125 - protein, 6 aa, Artificial Sequence
  Flexible linker sequence
DKTHTS

SEQ ID NO: 126 - protein, 6 aa, Artificial Sequence
  Flexible linker sequence
  misc_feature (1)..(1): Ser is optional
SGGGGS

SEQ ID NO: 127 - protein, 11 aa, Artificial Sequence
  Flexible linker sequence
  misc_feature (1)..(1): Ser is optional
SGGGGSGGGGS

SEQ ID NO: 128 - protein, 16 aa, Artificial Sequence
  Flexible linker sequence
  misc_feature (1)..(1): Ser is optional
SGGGGSGGGGSGGGGS

SEQ ID NO: 129 - protein, 21 aa, Artificial Sequence
  Flexible linker sequence
  misc_feature (1)..(1): Ser is optional
SGGGGSGGGGSGGGGSGGGGS

SEQ ID NO: 130 - protein, 26 aa, Artificial Sequence
  Flexible linker sequence
  misc_feature (1)..(1): Ser is optional
SGGGGSGGGGSGGGGSGGGGSGGGGS

SEQ ID NO: 131 - protein, 11 aa, Artificial Sequence
  Flexible linker sequence
AAAGSGGASAS

SEQ ID NO: 132 - protein, 16 aa, Artificial Sequence
  Flexible linker sequence
  misc_feature (7)..(7): Xaa can be any naturally occurring amino acid
AAAGSGXGGGSGASAS

SEQ ID NO: 133 - protein, 21 aa, Artificial Sequence
  Flexible linker sequence
  misc_feature (7)..(7): Xaa can be any naturally occurring amino acid
  misc_feature (12)..(12): Xaa can be any naturally occurring amino acid
AAAGSGXGGGSXGGGSGASAS

SEQ ID NO: 134 - protein, 26 aa, Artificial Sequence
  Flexible linker sequence
  misc_feature (7)..(7): Xaa can be any naturally occurring amino acid
  misc_feature (12)..(12): Xaa can be any naturally occurring amino acid
  misc_feature (17)..(17): Xaa can be any naturally occurring amino acid
AAAGSGXGGGSXGGGSXGGGSGASAS

SEQ ID NO: 135 - protein, 31 aa, Artificial Sequence
  Flexible linker sequence
  misc_feature (7)..(7): Xaa can be any naturally occurring amino acid
  misc_feature (12)..(12): Xaa can be any naturally occurring amino acid
  misc_feature (17)..(17): Xaa can be any naturally occurring amino acid
  misc_feature (22)..(22): Xaa can be any naturally occurring amino acid
AAAGSGXGGGSXGGGSXGGGSXGGGSGASAS

SEQ ID NO: 136 - protein, 13 aa, Artificial Sequence
  Flexible linker sequence
  misc_feature (7)..(7): Xaa can be any naturally occurring amino acid
AAAGSGXSGASAS

SEQ ID NO: 137 - protein, 28 aa, Artificial Sequence
  Flexible linker sequence
PGGNRGTTTTRRPATTTGSSPGPTQSHY

SEQ ID NO: 138 - protein, 11 aa, Artificial Sequence
  Flexible linker sequence
ATTTGSSPGPT

SEQ ID NO: 139 - protein, 6 aa, Artificial Sequence
  Flexible linker sequence
ATTTGS

SEQ ID NO: 140 - protein, 18 aa, Artificial Sequence
  Flexible linker sequence
MPSLSGVLQVRYLSPPDL

SEQ ID NO: 141 - protein, 21 aa, Artificial Sequence
  Flexible linker sequence
EPSGPISTINSPPSKESHKSP

SEQ ID NO: 142 - protein, 15 aa, Artificial Sequence
  Flexible linker sequence
GTVAAPSVFIFPPSD

SEQ ID NO: 143 - protein, 15 aa, Artificial Sequence
  Flexible linker sequence
GGGGIAPSMVGGGGS

SEQ ID NO: 144 - protein, 15 aa, Artificial Sequence
  Flexible linker sequence
GGGGKVEGAGGGGGS

SEQ ID NO: 145 - protein, 15 aa, Artificial Sequence
  Flexible linker sequence
GGGGSMKSHDGGGGS

SEQ ID NO: 146 - protein, 15 aa, Artificial Sequence
  Flexible linker sequence
GGGGNLITIVGGGGS

SEQ ID NO: 147 - protein, 15 aa, Artificial Sequence
  Flexible linker sequence
GGGGVVPSLPGGGGS

SEQ ID NO: 148 - protein, 12 aa, Artificial Sequence
  Flexible linker sequence
GGEKSIPGGGGS

SEQ ID NO: 149 - protein, 18 aa, Artificial Sequence
  Flexible linker sequence
RPLSYRPPFPFGFPSVRP

SEQ ID NO: 150 - protein, 18 aa, Artificial Sequence
  Flexible linker sequence
YPRSIYIRRRHPSPSLTT

SEQ ID NO: 151 - protein, 18 aa, Artificial Sequence
  Flexible linker sequence
TPSHLSHILPSFGLPTFN

SEQ ID NO: 152 - protein, 18 aa, Artificial Sequence
  Flexible linker sequence
RPVSPFTFPRLSNSWLPA

SEQ ID NO: 153 - protein, 18 aa, Artificial Sequence
  Flexible linker sequence
SPAAHFPRSIPRPGPIRT

SEQ ID NO: 154 - protein, 18 aa, Artificial Sequence
  Flexible linker sequence
APGPSAPSHRSLPSRAFG

SEQ ID NO: 155 - protein, 18 aa, Artificial Sequence
  Flexible linker sequence
PRNSIHFLHPLLVAPLGA

SEQ ID NO: 156 - protein, 18 aa, Artificial Sequence
  Flexible linker sequence
NPSLNPPSYLHRAPSRIS

SEQ ID NO: 157 - protein, 17 aa, Artificial Sequence
  Flexible linker sequence
LPWRTSLLPSLPLRRRP

SEQ ID NO: 158 - protein, 18 aa, Artificial Sequence
  Flexible linker sequence
PPLFAKGPVGLLSRSFPP

SEQ ID NO: 159 - protein, 18 aa, Artificial Sequence
  Flexible linker sequence
VPPAPVVSLRSAHARPPY

SEQ ID NO: 160 - protein, 17 aa, Artificial Sequence
  Flexible linker sequence
LRPTPPRVRSYTCCPTP

SEQ ID NO: 161 - protein, 18 aa, Artificial Sequence
  Flexible linker sequence
PNVAHVLPLLTVPWDNLR

SEQ ID NO: 162 - protein, 18 aa, Artificial Sequence
  Flexible linker sequence
CNPLLPLCARSPAVRTFP

SEQ ID NO: 163 - protein, 11 aa, Artificial Sequence
  rigid linker
GAPAPAAPAPA

SEQ ID NO: 164 - protein, 4 aa, Artificial Sequence
  rigid linker
PPPP

SEQ ID NO: 165 - skipped

SEQ ID NO: 166 - protein, 8 aa, Artificial Sequence
  Linker sequence
  misc_feature (7)..(7): Xaa can be any naturally occurring amino acid
  misc_feature (8)..(8): Xaa can be any naturally occurring amino acid
DKTHTCXX

SEQ ID NO: 167 - protein, 11 aa, Artificial Sequence
  Linker sequence
DKTHTCPPCPA

SEQ ID NO: 168 - protein, 18 aa, Artificial Sequence
  Linker sequence
DKTHTCPPCPATCPPCPA

SEQ ID NO: 169 - protein, 25 aa, Artificial Sequence
  Linker sequence
DKTHTCPPCPATCPPCPATCPPCPA

SEQ ID NO: 170 - protein, 30 aa, Artificial Sequence
  Linker sequences
DKTHTCPPCPAGKPTLYNSLVMSDTAGTCY

SEQ ID NO: 171 - protein, 31 aa, Artificial Sequence
  Linker sequence
DKTHTCPPCPAGKPTHVNVSVVMAEVDGTCY

SEQ ID NO: 172 - protein, 15 aa, Artificial Sequence
  Linker sequence
DKTHTCCVECPPCPA

SEQ ID NO: 173 - protein, 26 aa, Artificial Sequence
  Linker sequence
DKTHTCPRCPEPKSCDTPPPCPRCPA

SEQ ID NO: 174 - protein, 11 aa, Artificial Sequence
  Linker sequence
DKTHTCPSCPA

SEQ ID NO: 175 - protein, 8 aa, Artificial Sequence
  Linker sequence
  misc_feature (7)..(7): Xaa can be any naturally occurring amino acid
  misc_feature (8)..(8): Xaa can be any naturally occurring amino acid
DKTHTSXX

SEQ ID NO: 176 - protein, 11 aa, Artificial Sequence
  Linker sequence
DKTHTCPPSPA

SEQ ID NO: 177 - protein, 11 aa, Artificial Sequence
  Linker sequence
DKTHTSPPCPA

SEQ ID NO: 178 - protein, 11 aa, Artificial Sequence
  Linker sequence
DKTHTSPPSPA

SEQ ID NO: 179 - protein, 18 aa, Artificial Sequence
  Linker sequence
DKTHTCPPCPATCPPSPA

SEQ ID NO: 180 - protein, 18 aa, Artificial Sequence
  Linker sequence
DKTHTCPPCPATSPPCPA

SEQ ID NO: 181 - protein, 18 aa, Artificial Sequence
  Linker sequence
DKTHTCPPSPATCPPCPA

SEQ ID NO: 182 - protein, 18 aa, Artificial Sequence
  Linker sequence
DKTHTSPPCPATCPPCPA

SEQ ID NO: 183 - protein, 18 aa, Artificial Sequence
  Linker sequence
DKTHTCPPCPATSPPSPA

SEQ ID NO: 184 - protein, 18 aa, Artificial Sequence
  Linker sequence
DKTHTCPPSPATCPPSPA

SEQ ID NO: 185 - protein, 18 aa, Artificial Sequence
  Linker sequence
DKTHTSPPCPATCPPSPA

SEQ ID NO: 186 - protein, 18 aa, Artificial Sequence
  Linker sequence
DKTHTSPPSPATCPPCPA

SEQ ID NO: 187 - protein, 18 aa, Artificial Sequence
  Linker sequence
DKTHTSPPCPATSPPCPA

SEQ ID NO: 188 - protein, 18 aa, Artificial Sequence
  Linker sequence
DKTHTCPPSPATSPPCPA

SEQ ID NO: 189 - protein, 18 aa, Artificial Sequence
  Linker sequence
DKTHTSPPSPATSPPSPA

SEQ ID NO: 190 - protein, 18 aa, Artificial Sequence
  Linker sequence
DKTHTCPPSPATSPPSPA

SEQ ID NO: 191 - protein, 18 aa, Artificial Sequence
  Linker sequence
DKTHTSPPCPATSPPSPA

SEQ ID NO: 192 - protein, 18 aa, Artificial Sequence
  Linker sequence
DKTHTSPPSPATCPPSPA

SEQ ID NO: 193 - protein, 18 aa, Artificial Sequence
  Linker sequence
DKTHTSPPSPATSPPCPA

SEQ ID NO: 194 - protein, 25 aa, Artificial Sequence
  Linker sequence
DKTHTCPPCPATCPPCPATCPPSPA

SEQ ID NO: 195 - protein, 25 aa, Artificial Sequence
  Linker sequence
DKTHTCPPCPATCPPCPATSPPCPA

SEQ ID NO: 196 - protein, 25 aa, Artificial Sequence
  Linker sequence
DKTHTCPPCPATCPPSPATCPPCPA

SEQ ID NO: 197 - protein, 25 aa, Artificial Sequence
  Linker sequence
DKTHTCPPCPATSPPCPATCPPCPA

SEQ ID NO: 198 - protein, 25 aa, Artificial Sequence
  Linker sequence
DKTHTCPPSPATCPPCPATCPPCPA

SEQ ID NO: 199 - protein, 25 aa, Artificial Sequence
  Linker sequence
DKTHTSPPCPATCPPCPATCPPCPA

SEQ ID NO: 200 - protein, 25 aa, Artificial Sequence
  Linker sequence
DKTHTCPPCPATCPPCPATSPPSPA

SEQ ID NO: 201 - protein, 25 aa, Artificial Sequence
  Linker sequence
DKTHTCPPCPATCPPSPATCPPSPA

SEQ ID NO: 202 - protein, 25 aa, Artificial Sequence
  Linker sequence
DKTHTCPPCPATSPPCPATCPPSPA

SEQ ID NO: 203 - protein, 25 aa, Artificial Sequence
  Linker sequence
DKTHTCPPSPATCPPCPATCPPSPA

SEQ ID NO: 204 - protein, 25 aa, Artificial Sequence
  Linker sequence
DKTHTSPPCPATCPPCPATCPPSPA

SEQ ID NO: 205 - protein, 25 aa, Artificial Sequence
  Linker sequence
DKTHTCPPCPATCPPSPATSPPCPA

SEQ ID NO: 206 - protein, 25 aa, Artificial Sequence
  Linker sequence
DKTHTCPPCPATSPPCPATSPPCPA

SEQ ID NO: 207 - protein, 25 aa, Artificial Sequence
  Linker sequence
DKTHTCPPSPATCPPCPATSPPCPA

SEQ ID NO: 208 - protein, 25 aa, Artificial Sequence
  Linker sequence
DKTHTSPPCPATCPPCPATSPPCPA

SEQ ID NO: 209 - protein, 25 aa, Artificial Sequence
  Linker sequence
DKTHTCPPCPATSPPSPATCPPCPA

SEQ ID NO: 210 - protein, 25 aa, Artificial Sequence
  Linker sequence
DKTHTCPPSPATCPPSPATCPPCPA

SEQ ID NO: 211 - protein, 25 aa, Artificial Sequence
  Linker sequence
DKTHTSPPCPATCPPSPATCPPCPA

SEQ ID NO: 212 - protein, 25 aa, Artificial Sequence
  Linker sequence
DKTHTCPPSPATSPPCPATCPPCPA

SEQ ID NO: 213 - protein, 25 aa, Artificial Sequence
  Linker sequence
DKTHTSPPCPATSPPCPATCPPCPA

SEQ ID NO: 214 - protein, 25 aa, Artificial Sequence
  Linker sequence
DKTHTSPPSPATCPPCPATCPPCPA

SEQ ID NO: 215 - protein, 25 aa, Artificial Sequence
  Linker sequence
DKTHTCPPCPATCPPSPATSPPSPA

SEQ ID NO: 216 - protein, 25 aa, Artificial Sequence
  Linker sequence
DKTHTCPPCPATSPPCPATSPPSPA

SEQ ID NO: 217 - protein, 25 aa, Artificial Sequence
  Linker sequence
DKTHTCPPSPATCPPCPATSPPSPA

SEQ ID NO: 218 - protein, 25 aa, Artificial Sequence
  Linker sequence
DKTHTSPPCPATCPPCPATSPPSPA

SEQ ID NO: 219 - protein, 25 aa, Artificial Sequence
  Linker sequence
DKTHTCPPCPATSPPSPATCPPSPA

SEQ ID NO: 220 - protein, 25 aa, Artificial Sequence
  Linker sequence
DKTHTCPPSPATCPPSPATCPPSPA

SEQ ID NO: 221 - protein, 25 aa, Artificial Sequence
  Linker sequence
DKTHTSPPCPATCPPSPATCPPSPA

SEQ ID NO: 222 - protein, 25 aa, Artificial Sequence
  Linker sequence
DKTHTCPPSPATSPPCPATCPPSPA

SEQ ID NO: 223 - protein, 25 aa, Artificial Sequence
  Linker sequence
DKTHTSPPCPATSPPCPATCPPSPA

SEQ ID NO: 224 - protein, 25 aa, Artificial Sequence
  Linker sequence
DKTHTSPPSPATSPPCPATCPPCPA

SEQ ID NO: 225 - protein, 25 aa, Artificial Sequence
  Linker sequence
DKTHTSPPSPATCPPSPATCPPCPA

SEQ ID NO: 226 - protein, 25 aa, Artificial Sequence
  Linker sequence
DKTHTSPPSPATCPPCPATSPPCPA

SEQ ID NO: 227 - protein, 25 aa, Artificial Sequence
  Linker sequence
DKTHTSPPSPATCPPCPATCPPSPA

SEQ ID NO: 228 - protein, 25 aa, Artificial Sequence
  Linker sequence
DKTHTCPPSPATSPPSPATCPPCPA

SEQ ID NO: 229 - protein, 25 aa, Artificial Sequence
  Linker sequence
DKTHTCPPSPATSPPCPATSPPCPA

SEQ ID NO: 230 - protein, 25 aa, Artificial Sequence
  Linker sequence
DKTHTCPPSPATCPPSPATSPPSPA

SEQ ID NO: 231 - protein, 25 aa, Artificial Sequence
  Linker sequence
DKTHTCPPSPATSPPSPATCPPSPA

SEQ ID NO: 232 - protein, 25 aa, Artificial Sequence
  Linker sequence
DKTHTSPPSPATSPPCPATCPPSPA

SEQ ID NO: 233 - protein, 25 aa, Artificial Sequence
  Linker sequence
DKTHTSPPSPATSPPSPATCPPCPA

SEQ ID NO: 234 - protein, 25 aa, Artificial Sequence
  Linker sequence
DKTHTSPPSPATSPPCPATSPPCPA

SEQ ID NO: 235 - protein, 25 aa, Artificial Sequence
  Linker sequence
DKTHTSPPSPATSPPCPATCPPSPA

SEQ ID NO: 236 - protein, 25 aa, Artificial Sequence
  Linker sequence
DKTHTCPPSPATSPPSPATSPPCPA

SEQ ID NO: 237 - protein, 25 aa, Artificial Sequence
  Linker sequence
DKTHTCPPSPATSPPSPATSPPSPA

SEQ ID NO: 238 - protein, 25 aa, Artificial Sequence
  Linker sequence
DKTHTSPPSPATSPPSPATSPPCPA

SEQ ID NO: 239 - protein, 25 aa, Artificial Sequence
  Linker sequence
DKTHTSPPCPATSPPSPATSPPSPA

SEQ ID NO: 240 - protein, 25 aa, Artificial Sequence
  Linker sequence
DKTHTSPPSPATCPPSPATSPPSPA

SEQ ID NO: 241 - protein, 25 aa, Artificial Sequence
  Linker sequence
DKTHTSPPSPATSPPCPATSPPSPA

SEQ ID NO: 242 - protein, 25 aa, Artificial Sequence
  Linker sequence
DKTHTSPPSPATSPPSPATCPPSPA

SEQ ID NO: 243 - protein, 25 aa, Artificial Sequence
  Linker sequence
DKTHTSPPSPATSPPSPATSPPSPA

SEQ ID NO: 244 - protein, 30 aa, Artificial Sequence
  Linker sequence
DKTHTCPPCPAGKPTLYNSLVMSDTAGTSY

SEQ ID NO: 245 - protein, 30 aa, Artificial Sequence
  Linker sequence
DKTHTCPPSPAGKPTLYNSLVMSDTAGTCY

SEQ ID NO: 246 - protein, 30 aa, Artificial Sequence
  Linker sequence
DKTHTSPPCPAGKPTLYNSLVMSDTAGTCY

SEQ ID NO: 247 - protein, 30 aa, Artificial Sequence
  Linker sequence
DKTHTCPPSPAGKPTLYNSLVMSDTAGTSY

SEQ ID NO: 248 - protein, 30 aa, Artificial Sequence
  Linker sequence
DKTHTSPPSPAGKPTLYNSLVMSDTAGTCY

SEQ ID NO: 249 - protein, 30 aa, Artificial Sequence
  Linker sequence
DKTHTSPPCPAGKPTLYNSLVMSDTAGTSY

SEQ ID NO: 250 - protein, 30 aa, Artificial Sequence
  Linker sequence
DKTHTSPPSPAGKPTLYNSLVMSDTAGTSY

SEQ ID NO: 251 - protein, 31 aa, Artificial Sequence
  Linker sequence
DKTHTCPPCPAGKPTHVNVSVVMAEVDGTSY

SEQ ID NO: 252 - protein, 31 aa, Artificial Sequence
  Linker sequence
DKTHTCPPSPAGKPTHVNVSVVMAEVDGTCY

SEQ ID NO: 253 - protein, 31 aa, Artificial Sequence
  Linker sequence
DKTHTSPPCPAGKPTHVNVSVVMAEVDGTCY

SEQ ID NO: 254 - protein, 31 aa, Artificial Sequence
  Linker sequence
DKTHTCPPSPAGKPTHVNVSVVMAEVDGTSY

SEQ ID NO: 255 - protein, 31 aa, Artificial Sequence
  Linker sequence
DKTHTSPPCPAGKPTHVNVSVVMAEVDGTSY

SEQ ID NO: 256 - protein, 31 aa, Artificial Sequence
  Linker sequence
DKTHTSPPSPAGKPTHVNVSVVMAEVDGTCY

SEQ ID NO: 257 - protein, 31 aa, Artificial Sequence
  Linker sequence
DKTHTSPPSPAGKPTHVNVSVVMAEVDGTSY

SEQ ID NO: 258 - protein, 15 aa, Artificial Sequence
  Linker sequence
DKTHTCCVECPPSPA

SEQ ID NO: 259 - protein, 15 aa, Artificial Sequence
  Linker sequence
DKTHTCCVESPPCPA

SEQ ID NO: 260 - protein, 15 aa, Artificial Sequence
  Linker sequence
DKTHTCSVECPPCPA

SEQ ID NO: 261 - protein, 15 aa, Artificial Sequence
  Linker sequence
DKTHTSCVECPPCPA

SEQ ID NO: 262 - protein, 15 aa, Artificial Sequence
  Linker sequence
DKTHTCCVESPPSPA

SEQ ID NO: 263 - protein, 15 aa, Artificial Sequence
  Linker sequence
DKTHTCSVECPPSPA

SEQ ID NO: 264 - protein, 15 aa, Artificial Sequence
  Linker sequence
DKTHTSCVECPPSPA

SEQ ID NO: 265 - protein, 15 aa, Artificial Sequence
  Linker sequence
DKTHTCSVESPPCPA

SEQ ID NO: 266 - protein, 15 aa, Artificial Sequence
  Linker sequence
DKTHTSSVECPPCPA

SEQ ID NO: 267 - protein, 15 aa, Artificial Sequence
  Linker sequence
DKTHTCSVESPPSPA

SEQ ID NO: 268 - protein, 15 aa, Artificial Sequence
  Linker sequence
DKTHTSSVECPPSPA

SEQ ID NO: 269 - protein, 15 aa, Artificial Sequence
  Linker sequence
DKTHTSSVESPPCPA

SEQ ID NO: 270 - protein, 15 aa, Artificial Sequence
  Linker sequence
DKTHTSSVESPPSPA

SEQ ID NO: 271 - protein, 26 aa, Artificial Sequence
  Linker sequence
DKTHTCPRCPEPKSCDTPPPCPRSPA

SEQ ID NO: 272 - protein, 26 aa, Artificial Sequence
  Linker sequence
DKTHTCPRCPEPKSCDTPPPSPRCPA

SEQ ID NO: 273 - protein, 26 aa, Artificial Sequence
  Linker sequence
DKTHTCPRCPEPKSSDTPPPCPRCPA

SEQ ID NO: 274 - protein, 26 aa, Artificial Sequence
  Linker sequence
DKTHTCPRSPEPKSCDTPPPCPRCPA

SEQ ID NO: 275 - protein, 26 aa, Artificial Sequence
  Linker sequence
DKTHTSPRCPEPKSCDTPPPCPRCPA

SEQ ID NO: 276 - protein, 26 aa, Artificial Sequence
  Linker sequence
DKTHTCPRCPEPKSCDTPPPSPRSPA

SEQ ID NO: 277 - protein, 26 aa, Artificial Sequence
  Linker sequence
DKTHTCPRCPEPKSSDTPPPCPRSPA

SEQ ID NO: 278 - protein, 26 aa, Artificial Sequence
  Linker sequence
DKTHTCPRSPEPKSCDTPPPCPRSPA

SEQ ID NO: 279 - protein, 26 aa, Artificial Sequence
  Linker sequence
DKTHTSPRCPEPKSCDTPPPCPRSPA

SEQ ID NO: 280 - protein, 26 aa, Artificial Sequence
  Linker sequence
DKTHTCPRCPEPKSSDTPPPSPRSPA

SEQ ID NO: 281 - protein, 26 aa, Artificial Sequence
  Linker sequence
DKTHTCPRSPEPKSCDTPPPSPRSPA

SEQ ID NO: 282 - protein, 26 aa, Artificial Sequence
  Linker sequence
DKTHTSPRCPEPKSCDTPPPSPRSPA

SEQ ID NO: 283 - protein, 26 aa, Artificial Sequence
  Linker sequence
DKTHTCPRSPEPKSSDTPPPCPRSPA

SEQ ID NO: 284 - protein, 26 aa, Artificial Sequence
  Linker sequence
DKTHTSPRCPEPKSSDTPPPCPRSPA

SEQ ID NO: 285 - protein, 26 aa, Artificial Sequence
  Linker sequence
DKTHTSPRSPEPKSCDTPPPCPRSPA

SEQ ID NO: 286 - protein, 26 aa, Artificial Sequence
  Linker sequence
DKTHTCPRSPEPKSSDTPPPSPRCPA

SEQ ID NO: 287 - protein, 26 aa, Artificial Sequence
  Linker sequence
DKTHTSPRCPEPKSSDTPPPSPRCPA

SEQ ID NO: 288 - protein, 26 aa, Artificial Sequence
  Linker sequence
DKTHTSPRSPEPKSSDTPPPCPRCPA

SEQ ID NO: 289 - protein, 26 aa, Artificial Sequence
  Linker sequence
DKTHTCPRSPEPKSSDTPPPSPRSPA

SEQ ID NO: 290 - protein, 26 aa, Artificial Sequence
  Linker sequence
DKTHTSPRSPEPKSSDTPPPCPRSPA

SEQ ID NO: 291 - protein, 26 aa, Artificial Sequence
  Linker sequence
DKTHTSPRSPEPKSCDTPPPSPRSPA

SEQ ID NO: 292 - protein, 26 aa, Artificial Sequence
  Linker sequence
DKTHTSPRCPEPKSSDTPPPSPRSPA

SEQ ID NO: 293 - protein, 26 aa, Artificial Sequence
  Linker sequence
DKTHTSPRSPEPKSSDTPPPSPRSPA

SEQ ID NO: 294 - protein, 11 aa, Artificial Sequence
  Linker sequence
DKTHTCPSSPA

SEQ ID NO: 295 - protein, 11 aa, Artificial Sequence
  Linker sequence
DKTHTSPSCPA

SEQ ID NO: 296 - protein, 11 aa, Artificial Sequence
  Linker sequence
DKTHTSPSSPA

SEQ ID NO: 297 - protein, 4 aa, Artificial Sequence
  Linker sequence
GGGS

SEQ ID NO: 298 - DNA, 35759 bp, Artificial Sequence
  NG-616 genome sequence
tctatctatataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaacaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatctggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgaggaattggtatttgaagtcgatgtcgtcacaggctccctgttcccagagttggaagtctacccgtttcttgtaggcggggttgggcaaagcgaaagtaacatcattgaagagaatcttgccggccctgggcatgaaattgcgagtgatgcgaaaaggctgtggtacttccgctcggttattgataacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggattcgctttaaggaaggaggaccagaggtccactgccagtgctgtttgtaactggtcccggtactgacgaaaatgccgtccgactgccattttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtagtcgcagcgttgcacgggttgtatctcgtgaatgagttgtacctggcttcccttgacgagaaatttcagtgggaagccgaggcctggcgattgtatctcgtgctttactatgttgtctgcatcggcctgttcatcttctgtctcgatggtggtcatgctgacgagccctcgcgggaggcaagtccagacctcggcgcggcaggggcggagctcgaggacgagagcgcgcaggctggagctgtccagggtcctgagacgctgcggactcaggttagtaggcagtgtcaggagattaacttgcatgatcttttggagggcgtgcgggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcaccagagttgtcctggtaggcgatctccgccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacggcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagagcttccaagcgctccatggcctcgtagaagtccacggcaaaattaaaaaactgggagtttcgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttgcgatcgctttctctcttcaggcccaccatgggctggagctgcatcatcttgttcctggtcgcaactgctaccggagtccattcggacatcgtcatgacccaaagccctgactcgctcgctgtgtcactgggagagcgggcgactatcaactgcaaatcatcccagagcctgctgtattcacgcaatcagaaaaactacctggcctggtatcagcagaagccgggccagcctcccaagctgctgatcttctgggcctccacccgcgaaagcggcgtgccggaccgcttcagcggaagcggattcggaactgactttactctgaccattagctccttgcaggcggaggacgtggccgtctactactgccagcagtatttctcctatccgctcacctttgggcaaggcaccaaggtggagattaagggagggggcggcagcgggggaggcggcagcggcggcgggggatcgcaggtccagctcgtccaatccggagccgaagtcaagaagccgggagcgtcggtcaaggtcagctgcaaaacttcgcgctacaccttcactgagtacacgatccactgggtccgccaggcgcccggccagcggctggagtggatcggcgggatcaacccaaacaacggaatcccaaattacaatcagaaatttaaagggcgggtgactatcaccgtggatacctcggcctccacggcgtacatggagctctcatcactcagatcggaggacaccgcggtctattactgcgcccgccgccggatcgcttatggatacgatgaaggacatgcgatggattactggggccagggcaccctcgtcacggtgtcgtcaggaggcggcggttcacaggtgcagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccactctcacagtctcctcaggtggcggtggctcgggcggtggtggatctggtggcggcggatctgatatcgtgctcactcagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggaagcggacagtgtactaattatgctctcttgaaattggctggagatgttgagagcaaccctggacctacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctccaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctacaggagacctccgagcagctggtggcgctgaagccctggatcactcgccagaacttctcccggtgcctggagctgcagtgtcagcccgactcctcaaccctgccacccccatggagtccccggcccctggaggccacagccccgggaagcggagctactaacttcagcctgctgaagcaggctggagacgtggaggagaaccctggacctcaggtctccactgctgcccttgccgtcctcctctgcaccatggctctctgcaaccaggtcctctctgcaccacttgctgctgacacgccgaccgcctgctgcttcagctacacctcccgacagattccacagaatttcatagctgactactttgagacgagcagccagtgctccaagcccagtgtcatcttcctaaccaagagaggccggcaggtctgtgctgaccccagtgaggagtgggtccagaaatacgtcagtgacctggagctgagtgccggaagcggagagggcagaggaagtctgctaacatgcggtgacgtcgaggagaatcctggacctgccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaataagctagcttgactgactgagatacagcgtaccttcagctcacagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtagtcgtcagctatcctgcaggaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattatatagataga

The invention claimed is:

1. A group B oncolytic adenovirus comprising a sequence of formula (I):

5'TTR-B$_1$-B$_A$-B$_2$-B$_X$-B$_B$-B$_Y$-B$_3$-3'TTR    (I)

wherein:
B$_1$ is absent or comprises: E1A, E1B or E1A-E1B;
B$_A$ comprises: E2B-L1-L2-L3-E2A-L4;
B$_2$ is absent or comprises: E3;
B$_X$ is absent or a DNA sequence comprising: a restriction site, one or more transgenes or both;
B$_B$ comprises: L5;
B$_Y$ is a DNA sequence comprising: at least one transgene;
B$_3$ is absent or comprises: E4;
wherein the transgene in position B$_Y$ encodes a bispecific T cell activator comprising at least two binding domains wherein:
one of the binding domains is specific to CD3; and
one of the binding domains is specific to a tumour stromal antigen selected from the group consisting of fibroblast activation protein (FAP), TREM1, IGFBP7, FSP-1, platelet-derived growth factor-α receptor (PDGFR-α), platelet-derived growth factor-β receptor (PDGFR-β) and vimentin, and
the adenovirus is Enadenotucirev (EnAd) or serotype 11 adenovirus (Ad11).

2. An oncolytic adenovirus according to claim 1, wherein the adenovirus is EnAd.

3. An oncolytic adenovirus according to claim 1, wherein the CD3 is CD3ε.

4. An oncolytic adenovirus according to claim 1, wherein the tumour stromal antigen is FAP.

5. An oncolytic adenovirus according to claim 1, wherein the adenovirus is replication capable.

6. An oncolytic adenovirus according to claim 1, wherein the adenovirus is replication competent.

7. An oncolytic adenovirus according to claim 1, wherein the adenovirus is replication deficient.

8. An oncolytic adenovirus according to claim 1, wherein the bispecific T cell activator that is encoded in position B$_Y$ is under the control of the major late promoter.

9. An oncolytic adenovirus according to claim 1, wherein the adenovirus further encodes a second bispecific T cell activator.

10. An oncolytic adenovirus according to claim 9, wherein both bispecific T cell activators are encoded in position $B_y$.

11. An oncolytic adenovirus according to claim 9, wherein the first bispecific T cell activator molecule is specific to a tumour antigen, and the second bispecific T cell activator molecule is specific to a tumour stromal antigen.

12. An oncolytic adenovirus according to claim 1, wherein the encoded bispecific T cell activator comprises a VH domain comprising an amino acid sequence as set forth in SEQ ID NO: 8 and a VL comprising an amino acid sequence as set forth in SEQ ID NO: 9.

13. An oncolytic adenovirus according to claim 12, wherein the encoded bispecific T cell activator comprises an scFv comprising an amino acid sequence as set forth in SEQ ID NO: 7.

14. An oncolytic adenovirus according to claim 1, wherein the encoded bispecific T cell activator comprises a VH domain comprising an amino acid sequence as set forth in SEQ ID NO: 13 and a VL comprising an amino acid sequence as set forth in SEQ ID NO: 12.

15. An oncolytic adenovirus according to claim 14, wherein the encoded bispecific T cell activator comprises an scFv comprising an amino acid sequence as set forth in SEQ ID NO: 11 or 75.

16. An oncolytic adenovirus according to claim 1, wherein the encoded bispecific T cell activator comprises a VH domain comprising an amino acid sequence as set forth in SEQ ID NO: 18 and a VL comprising an amino acid sequence as set forth in SEQ ID NO: 17.

17. An oncolytic adenovirus according to claim 16, wherein the encoded bispecific T cell activator comprises an scFv comprising an amino acid sequence as set forth in SEQ ID NO: 16 or 73.

18. An oncolytic adenovirus according to claim 14, wherein the adenovirus comprises a sequence shown in SEQ ID NO: 36, 37, 81, 82, 97, 98, 99 or 100.

19. An oncolytic adenovirus according to claim 1, wherein the adenovirus encodes 2, 3 or 4 further transgenes.

20. An oncolytic virus according to claim 19, wherein a different cleavage peptide is encoded between each of the transgenes.

21. An oncolytic adenovirus according to claim 19, wherein the further transgene(s) encodes a cytokine, chemokine and/or an immunomodulator.

22. An oncolytic adenovirus according to claim 19, wherein the further transgene(s) is in position $B_y$.

23. An oncolytic adenovirus according to claim 19, wherein at least one further transgene encodes a cytokine selected from the group comprising MIP1α, IL-1α, IL-1β, IL-6, IL-9, IL-12, IL-13, IL-17, IL-18, IL-22, IL-23, IL-24, IL-25, IL-26, IL-27, IL-33, IL-35, IL-2, IL-4, IL-5, IL-7, IL-10, IL-15, IL-21, IL-25, IL-1RA, IFNα, IFNγ, TNFα, lymphotoxin α (LTA), Flt3L, GM-CSF and IL-8.

24. An oncolytic adenovirus according to claim 19, wherein at least one further transgene encodes a chemokine selected from the group comprising CCL2, CCL3, CCL5, CCL17, CCL20, CCL22, CXCL9, CXCL10, CXCL11, CXCL13, CXCL12, CCL2, CCL19 and CCL21.

25. A composition comprising an adenovirus according to claim 1 and a diluent or carrier.

26. A composition according to claim 25, wherein the composition comprises a second oncolytic virus.

* * * * *